United States Patent 12,569,549 (FLAVIVIRUS VACCINE) - sequence listing, part 8

SEQ ID NO: 5558 - RNA, 9879 nt, synthetic construct
  misc_feature 1..9879: note = derived and/or modified CDS sequence (wt) from DENV-1__KJ189365__SS-prME
  source 1..9879: mol_type = other RNA
tccgtgaccatgctcctcatgctgctgcccacagccctggcgtttcatttgaccacacgagggggagagccacacatgatagttagtaagcaggaaagaggaaagtcactcttgtttaagacctctgcgggcgtcaatatgtgcaccctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggaaacaaatacaaagagtggaaacttgggctttgagacacccaggattcacggtgatagccttttttttagcacatgctataggaacatccatcactcagaaagggatcattttcatcttgctgatgctggtgacaccatcaatggccatgcgatgcgtgggaataggcaacagagacttcgttgaaggactgtcaggagcaacgtgggtggacgtggtactggagcacggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggccacactggtggaagaacaagacgcgaactttgtgtgtcgccgaacgtttgtggacagaggctggggtaatggctgcggactattcggaaagggaagtctattgacgtgtgccaagttcaagtgtgtgacaaaactagaaggaaagatagttcaatatgaaaacctaaaatattcagtgatagtcactgtccacactggggaccagcaccaggtgggaaacgagaccacagaacatggaacaattgcaaccataacacctcaagctcccacgtcggaaatacagctgaccgactacggagccctcacattggactgctcacctagaacagggctggactttaatgagatggtgctattgacaatgaaagaaaaatcatggcttgtccacaaacaatggtttctagacttgccactgccatggacttcgggggcttcaacatcccaagagacctggaacagacaagatttgctggtcacattcaagacagctcatgcaaagaaacaggaagtagtcgtattgggatcacaggaaggagcaatgcatactgcgttgactggggcgacagaaatccagacgtcaggaacgacaacaatcttcgcaggacacctgaaatgcagactaaaaatggataaactgaccttaaaggggatgtcatatgtgatgtgcacaggctcatttaagctagagaaggaagtggctgagacccagcatggaactgttctagtgcaggtcaaatatgaaggaacagacgcgccatgcaagatccccttttcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatctgtgggaaaattggtacaccagatttttggaaccgcatatggggttctgtttagcggtgtttcttggaccatgaaaataggaatagggattctgctgacatggttgggattaaattcaaggagcacgtcactttcgatgacgtgcattgtagttggcatggtcacactgtacctaggagtcatggttcaagcggattcgggatgtgtgatcaactggaagggcagagaacttaaatgcggaagtggcatttttgtcactaatgaagtccacacttggacagagcaatacaaattccaggctgactccccaaaaagactgtcagcagccattggaaaggcgtgggaggagggcgtgtgtggaattcgatcagccacgcgtcttgagaacatcatgtggaagcagatatcaaatgaattgaaccacattttacttgagaatgacatgaaattcacagtggttgtaggagatgccaacggaattttggcccaaggaaaaaaaatgattaggccacaacccatggaacacaaatactcatggaaaagctggggaaaagctaaaatcataggagcagacatacaaaataccaccttcattatcgacggcccagacaccccagaatgtcctgatggccaaagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagttggcgagagcctccttcatagaagtcaaaacatgcacctggccgaaatctcacactctatggagcaatggagttttggaaagtgaaatgataatcccaaagatatatggaggaccaatatctcagcacaactacagaccagggtatttcacacaaacagcagggccatggcacctaggtaagttggaactggattttgacttgtgtgaaggcaccacagttgttgtggatgaacattgtggaaatcgaggtccatctctcagaaccacaacagtcacaggaaagataatccatgaatggtgttgcagatcctgcacgctaccccccttacgtttcagaggagaagacgggtgttggtatggcatggaaatcagaccagtgaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgtcttcctccttcttataatgggacaactgacatggaatgatctgattaggttatgcatcatggtcggagctaacgcttcagacaggatggggatgggaacaacgtacctagccttgatggctactttcaaaatgagaccaatgttcgctgtagggctattattccgcagactaacatccagagaagttcttctcctaacgattggattaagcctggtggcatccgtggagctaccaaattccttggaggagctaggggatggacttgcaatgggtatcatgatgttaaaattgttgactgaatttcagccacaccagttatggaccaccttattgtctctgacatttgtcaaaacaactctctcattggattatgcatggaaaacaacggctatggcactgtctatcgtatctctctttcctttatgcctgtctacgacctcccaaaaaacaacatggcttccggtgctgttaggatcttttggatgcaaaccattaaccatgtttcttataacagaaaataaaatctggggaaggaaaagttggcccctcaatgaaggaattatggctattggaatagtcagcattctactaagctcactcctcaaaaatgatgtgccgttggccgggccattaatagctggaggcatgctaatagcatgttatgtcatatccggtagctcagccgatttatcattggagaaagcggctgaagtatcctgggaacaagaagcagaacactccggtgcctcacacagcatattagtagaggtccaagatgatggaactatgaaaataaaagatgaagagagggatgacacactcaccatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgataatggcatctatagaatcttgcaaagaggattgttgggcaggtcccaagtaggagtgggagttttccaagacggcgtgttccacacaatgtggcacgttaccaggggagctgtccttatgtaccaagggaagagactggaaccaagctgggccagtgtgaaaaaggacttgatctcatatggaggaggttggaggttccaaggatcatggaacacgggagaagaagtgcaggtaatagctgttgaaccaggaaaaaaccccaaaaatgtacagacaacgccgggcacctttaagactcctgaaggcgaagttggagccatagctctagatttcaaacccggcacatctggatctcccatcgtgaacagagagggaaaaatagtgggtctgtatggaaatggagtggtgacaacaagtggaacctacgtcagtgccattgcccaagctaaagcatcacaggaagggcctctaccagagattgaggacgaggtatttaagaaaagaaacttaacaataatggacctgcacccaggatcagggaaaacaagaagatatcttccagccatagtccgtgaggccataaaaaggaaactgcgtacgttaatcctggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgatcattatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattctagccggaccgatgccagtgactgcggccagtgctgcccagaggagaggaagaattggaaggaaccaaaacaaggaaggtgatcagtatgtttatatgggacagcctttaaataatgatgaggatcacgctcattggacagaagcaaaaatgctccttgacaatataaacacaccagaagggatcatcccagccctttttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggacgccagaacatactctgatccattggccctgcgcgagtttaaagagttcgcagcaggaagaagaagtgtctcaggtgacctgatattggaaatagggaaacttccacaacatttgacgttaagagcccagaatgctctggacaacttggtcatgttgcacaattccgaacaaggaggaaaagcctacagacatgccatggaggaactaccagacaccatagaaacattgatgctactagctttgatagctgtgttgactggtggagtgacgctgttcttcctatcaggaaaaggcctagggaaaacatccattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgccacaatgctggacgtagacctacacccagcttcagcctggaccctctatgcagtagccacaacagtcatcactcccatgatgagacacacaattgaaaatacaacggcaaacatttccctgaccgccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagcccaaaaaaggacagcagccggaataatgaaaaatccaaccgtagacgggattgttgcaatagacttggatcctgtggtttatgatgcaaaatttgaaaaacaactaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaatattttcaggggaagttatctagcaggagcaggtctggctttctcattgatgaaatctttaggaggaggtaggagaggcacgggagctcaaggggaaacactgggagagaaatggaaaagacagttgaaccaactgagcaagtcagaattcaacacctacaaaaggagtgggattatggaggtggacagatccgaagccaaagagggactgaaaagaggagaaacaaccaaacatgcagtgtcaagaggaacagccaaactgaggtggtttgtggagaggaacctcgtgaaaccagaaggaaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaaactacactctggaaaggatgtattttttatgccacctgagaaatgtgacactcttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcgaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagaaaatataaaaaatgaacacaagtcaacatggcattatgatgaggacaatccatacaaaacatgggcctatcatggatcatatgaggtcaagccatcaggatcagcctcatctatggtgaatggagtggtgagattgctcacgaaaccatgggatgtcatccccatggtcacacaaatagctatgactgataccacaccctttggacaacagagagtgtttaaagagaaagttgacacgcgcacaccaagagcaaaacgaggcacaacacagattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggttttatgaatgaagatcactggtttagtagagagaattcactcagtggagtggaaggagaaggactgcacaaacttggatacatactcagagacatatcaaagattccggggggaaatatgtatgcagatgatacagccggatgggacacaagagtaacagaggatgacctccagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgatcagagagggagtggacaggtcggaacttatggcttaaatactttcaccaatatggaggtccaactaataagacaaatggagtctgagggaatctttttacccagcgaattggaaacccccaacctagctgagagggctcttgactggttagaaaaacatggcgccgaaaggctgaaacgaatggcaatcagcggagatgattgcgtggtgaaaccaattgacgacaggttcgcaacagccttaacagctctgaatgacatgggaaaagtaaggaaagacataccgcagtgggaaccttcaaaaggatggaatgattggcagcaagtgcctttttgttcacaccatttccaccaactgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagacgaaaacccatggatggagaacaaaactcatgtatccagttgggaagaagttccatacctaggaaaaagggaagatcaatggtgtggatccctgataggcttgacagcgagggccacctgggccaccaacatacaagtagccataaaccaagtgagaaggctcatcgggaatgagaattatttagattacatgacatcaatgaagagattcaagaatgagagtgattccgaaggagcactctggtaa

SEQ ID NO: 5559 - RNA, 9879 nt, synthetic construct
  misc_feature 1..9879: note = derived and/or modified CDS sequence (wt) from DENV-1__KJ189366__SS-prME
  source 1..9879: mol_type = other RNA
tccgtgaccatgctcctcatgctgctgcccacagccctggcgtttcatttgaccacacgagggggagagccacacatgatagttagtaagcaggaaagaggaaagtcactcttgtttaagacctctgcgggcgtcaatatgtgcaccctcattgcgatggacttgggagagttatgtgaggacacaatgacctacaaatgcccccggatcgctgaggcggaaccagatgacgttgactgctggtgcaatgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggaaacaaatacaaagagtggaaacttgggctttgagacacccaggattcacggtaatagccttttttttagcacatgctattggaacatccatcactcagaaagggatcattttcatcttgctgatgctggtgacaccatcaatggccatgcgatgcgtgggaataggcaacagagacttcgttgaaggactgtcaggagcaacgtgggtggacgtggtactggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgcggactattcggaaagggaagtctattgacgtgtgccaagttcaagtgtgtgacaaaactagaaggaaagatagttcaatatgaaaacctaaaatattcagtgatagtcactgtccacactggggaccagcaccaggtgggaaacgagaccacagaacatggaacaattgcaaccataacacctcaagctcccacgtcggaaatacagctgaccgactacggagctctcacattggactgctcacctagaacagggctggactttaatgagatggtgctattgacaatgaaagaaaaatcatggcttgtccacaaacaatggtttctagacttgccactgccatggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgtagactaaaaatggacaaactgaccttaaaggggatgtcatatgtgatgtgcacaggctcatttaagctagagaaggaagtggctgagacccagcatggaactgttctagtgcaggtcaaatatgaaggaacagacgcgccatgcaagatccccttttcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgttcacatctgtgggaaaattggtacaccagatttttggaaccgcatatggggttctgtttagcggagtttcttggaccatgaaaataggaatagggattctgctgacatggttgggattaaattcaaggagcacgtcactttcgatgacgtgcattgcagttggcatggtcacactgtacctaggagtcatggttcaagcggattcgggatgtgtaatcaactggaaaggcagagaacttaaatgtggaagtggcatttttgtcactaatgaagtccacacttggacagagcaatacaaattccaggctgactccccaaaaagactgtcagcagccattggaaaggcgtgggaggagggcgtgtgtggaattcgatcagccacgcgccttgagaacatcatgtggaagcagatatcaaatgaattgaaccacattttacttgagaatgacatgaaattcacagtggttgtaggagatgccaacggaattttggcccaagggaaaaaaatgattaggccacaacccatggaacacaaatactcatggaaaagctggggaaaagctaaaatcataggagcagacatacaaaataccaccttcatcatcgacggcccagacaccccagaatgtcccgatggccaaagagcatggaacatttgggaagttgaggactatgggtttggagttttcacgacaaacatatggctgaaattgcgagactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactacagaccagggtattttacacaaacagcagggccatggcacctaggtaagttggaactggattttgacttgtgtgaaggtaccacagttgttgtggatgaacattgtggaaatcgaggtccatctctcagaaccacaacagtcacaggaaagataatccatgaatggtgttgcagatcctgcacgctaccccccttacgtttcagaggagaagacgggtgttggtatggcatggaaatcagaccagtgaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggccgttttcctccttcttataatgggacaactgacatggaatgatctgattaggttatgcatcatggttggagctaacgcttcagacaggatggggatgggaacaacgtacctagccttgatggctactttcaaaatgagaccaatgttcgctgtagggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttattgtctctgacatttgtcaaaacaactctctcattagattatgcatggaaaacaacggctatggcactgtctattgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattttattaagctcactcctcaaaaatgatgtgccgttggccgggccactaatagctggaggcatgctaatagcatgttatgtcatatctggtagctcagccgatttatcattggagaaagcggctgaagtatcctgggaacaagaagcagaacactccggtgcctcacacagcatattagtagaggtccaagatgatggaactatgaaaataaaagatgaagagagggatgacacactcaccatactccttaaagcaactttgctggcagtctcaggagtgtacccaatgtcaataccagcaactctttttgtgtggtatttttggcagaaaaagaaacagagatcaggagtattatgggacacacccagccctccggaagtggaaagagcagttcttgataatggcatctatagaatcttgcaaagaggattgttgggcaggtcccaagtaggagtgggagttttccaagacggcgtgttccacacaatgtggcacgttaccaggggagctgtccttatgtaccaagggaagagactggaaccaagctgggccagtgtaaaaaaggacttgatctcatatggaggaggttggaggttccaaggatcatggaacacgggagaagaagtgcaggtgatagctgttgaaccaggaaaaaaccctaaaaatgtacagacaacgccgggcaccttcaagactcctgaaggcgaagttggagccatagctctagatttcaaacccggcacatctggatctcccattgtgaacagagagggaaaaatagtgggtctgtatggaaatggagtggtgacaacaagtggaacctacgtcagtgccattgcccaagctaaagcatcacaggaagggcctctaccagagattgaggacgaggtatttaagaaaagaaacttaacaataatggacctgcacccaggatcagggaaaacaagaagatatcttccagccatagtccgtgaggccataaaaaggaaattgcgtacgttaatcctggctcccacaagagttgtcgcctctgaaatggcagaggcactcaagggaatgccaataagatatcagacaacagcagtgaagagtgaacacacaggaagggagatagttgacctcatgtgccacgccacttttaccatgcgtctcttatccccagtgagagttcccaattacaacatgattattatggatgaagctcattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacagtgactgggactatgttgtcacaacagacatttctgaaatgggggcaaatttccgggccgacagggtaatagacccaaggcggtgcttgaaaccggtaatactaaaagatggtccagagcgtgtcattctagccggaccgatgccagtgactgcggccagtgctgcccagaggagaggaagaattggaaggaaccaaaacaaggaaggtgatcagtatgtttatatgggacagcctttaaataatgatgaagatcacgctcattggacagaagctaaaatgctccttgacaatataaacacaccagaagggatcatcccagccctttttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggagaggaacaaccaggtgttggaggagaacatggacgtggagatctggacaaaggaaggagaaagaaagaaattgcgacctcgctggttggacgccagaacatactctgatccattggccctgcgcgagtttaaagagttcgcagcaggaagaagaagtgtctcaggtgacctaatattggaaatagggaaacttccacaacatttgacgctaagagcccagaatgctctggataacttggtcatgttgcacaattccgaacaaggaggaaaagcctacagacatgctatggaggaactaccagacaccatagaaacattgatgctactagctttgatagctgtgttgactggtggagtgacgctgttcttcctatcaggaaaaggcctagggaaaacatccattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgtcacaatgctggacgtagacctacacccagcttcagcctggaccctctatgcagtagccacaacagtcatcactcccatgatgagacacacaattgaaaatgcaacggcaaacatttccctgaccgccattgcaaatcaggcagctatattgatgggacttgacaagggatggccaatatcgaagatggacataggagttccacttctcgccttagggtgctattcccaggtgaacccattgacactgacagcggcggtgttgatgttagtggcccattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacaactaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaatattttcaggggaagttatctagcaggagcaggtctggctttctcattaatgaaatctttaggaggaggtaggagaggcacgggagctcaaggggaaacactgggagagaaatggaaaagacagttgaaccaactgagcaagtcagaattcaacacctacaaaaggagtgggattatggaggtggacagatccgaagccaaagagggactgaaaagaggagaaacaaccaaacatgcagtgtcaagaggaacagccaaactgaggtggtttgtggagaggaacctcgtgaaaccagaaggaaaagtcatagacctcggttgtggaagaggtggctggtcatattattgtgctgggctgaagaaagttactgaagtgaagggatacacaaaaggaggacctggacatgaggaacctatcccaatggcgacctacggatggaacctagtaaaactacactctggaaaggatgtattttttatgccacctgagaaatgtgacacccttctgtgtgatattggtgagtcctctccgaatccaactgtagaagaaggaagaacgttacgtgttctaaaaatggtggaaccatggctcagaggaaaccaattctgcataaaaatcctaaatccttacatgccaagtgtggtagaaactctggagcgaatgcaaagaaaacatggagggatgctagtgcgaaacccactctcaagaaattccacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagctaacctagatatcattggccagaggatagagaatataaaaaatgaacacaagtcaacatggcattatgatgaggacaatccatacaaaacatgggcctatcatggatcatatgaggtcaagccatcaggatcagcctcatccatggtgaatggagtggtgagattgctcacgaaaccatgggatgtcatccccatggtcacacaaatagctatgactgataccacacccttcggacaacagagagtgtttaaagagaaagttgacacgcgcacaccaagagcaaagcgaggcacaacacagattatggaggtgacagccaagtggttatggggtttcctttccagaaacaaaaaacccagaatctgcacaagagaggagttcacaagaaaggttaggtcaaacgcggcagtaggagcagtgttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggcttcatgaatgaagatcactggtttagtagagagaattcactcagtggagtggaaggagaaggactgcacaaacttggatacatactcagagacatatcaaagattccggggggaaatatgtatgcagatgatacagccggatgggacacaagagtaacagaggatgatcttcagaatgaggctaaaatcactgacatcatggagcctgaacatgctctattggccacgtcaatttttaagctgacttatcaaaacaaggtggtgagggtgcaaagaccagcaaaaaatggaaccgtgatggatgttatatccagacgtgatcagagaggaagtggacaggtcggaacttatggcttaaatactttcaccaacatggaggtccaactaataagacaaatggagtctgaaggaatctttttacccagcgaattggaaacccccaacctagctgagagggctcttgactggttagaaaaacatggcgccgaaaggctcaaacgaatggcaatcagcggagatgattgcgtggtgaaaccaattgacgacaggttcgcaacagccttaacagctctgaatgacatgggaaaagtaagaaaagacataccgcagtgggaaccttcaaaaggatggaatgattggcaacaagtgcctttttgttcacaccatttccaccaactgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtactttcacaggagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggagaacaaaactcatgtatccagttgggaagaagttccatacctaggaaaaagggaagatcaatggtgtggatccctgataggcttgacagcgagggccacctgggccaccaacatacaagtagccataaaccaagtgagaaggctcatcgggaatgagaattatttagattacatgacatcaatgaagagattcaagaatgagagtgattccgaaggagcactctggtaa

SEQ ID NO: 5560 - RNA, 9879 nt, synthetic construct
  misc_feature 1..9879: note = derived and/or modified CDS sequence (wt) from DENV-1__JN819417__SS-prME
  source 1..9879: mol_type = other RNA
tccgtgaccatgctcctcatgctgctgcccacagccctggcgttccatttgaccacacgagggggagagccacacatggtagttagcaagcaggaaagaggaaagtcactcttgtttaagacctctgcaggtgtcaacatgtgtactctcattgcgatggatttgggagagttatgtgaggacacaatgacctacaaatgcccccggattactgaggcggaaccagatgacgttgactgctggtgcaatgccacagacacatgggtgacctatgggacatgttctcaaaccggcgaacaccgacgagacaaacgttctgtggcactggccccacacgtgggacttggtctagaaacaagaaccgaaacatggatgtcctctgaaggcgcctggaaacaaatacaaaaagtggagacttgggctttgagacacccaggattcacggtgatagccctttttttagcacatgccataggaacatccatcactcagaaagggatcattttcattttgctgatgctggtaacaccatcaatggccatgcgatgcgtgggaataggcaacagagacttcgttgaaggactgtcaggagcgacgtgggtggacgtggtgttggagcacggaagctgcgtcactaccatggcaaaaaacaaaccaacattggacattgaactcttgaagacggaggtcacgaaccctgccatcttgcgcaaactgtgcattgaagctaaaatatcaaacaccaccaccgattcaagatgtccaacacaaggagaggctacactggtggaagaacaagacgcgaactttgtgtgtcgacgaacgtttgtggacagaggctggggcaatggttgcggactatttggaaaaggaagcctactgacgtgtgctaagttcaagtgtgtgacaaaactggaaggaaagatagttcaacatgaaaacttaaaatattcagtgatagtcactgtccacactggggaccagcaccaagtgggaaacgagactacagaacatggaacaattgcaactataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttgccactgccttggacttcgggggcttcaacatcccatgagacttggaacagacaagatttgctggtcacgttcaagacagctcatgcaaagaaacaggaagtggtcgtactgggatcacaggaaggagcaatgcacactgcgttgactggggcgacagaaatccagacgtcaggaacgacaacaatctttgcaggacacctgaaatgcagactaaaaatggataaactgactttaaaagggatgtcgtatgtgatgtgcacaggctcatttaagctagagaaggaagtggctgagacccagcatggaactgtcctagtgcaggttaaatacgaaggaacagacgcgccatgcaagatccccttttcgacccaagatgagaaaggagtgacccagaatggaaggttgataacagccaatcccatagttactgataaagaaaaaccagtcaacattgagacagaaccaccttttggtgagagctacatcgtggtaggggcaggtgaaaaagctttgaaactaagctggttcaagaaaggaagcagcatagggaaaatgttcgaagcaaccgcccgaggagcacgaaggatggctatcctgggagataccgcatgggacttcggctccataggaggagtgttcacgtctgtgggaaaattggtacaccaggtttttggaaccgcatatggggttctgttcagcggtgtttcttggaccatgaaaataggaatagggattctgctgacatggttggggttgaattcaaggagcacgtcactttcgatgacgtgcattgctgttggcatggttacactgtacctaggggtcatggttcaagcggactcgggatgtgtaatcaactggaagggcagagaactcaaatgtggaagtggcatttttgtcactaatgaagtccacacttggacagagcaatacaaattccaggctgactccccaaaaagactgtcagcagccattgggaaggcatgggaggagggcgtatgtggaattcgatcagccacgcgtcttgagaacatcatgtggaagcaaatatcaaatgaattgaaccacattctacttgaaaatgacatgaaattcacagtggttgtaggagatgctagtggaattttggcccagggaaaaaaaatgatcaggccacaacccatggaacacaaatactcatggaaaagttggggaaaagccaaaatcataggagcagacacacagaataccaccttcatcatcgacggccccgatactccagaatgccccgatgaccaaagagcgtggaacatttgggaagttgaggactatgggtttggaatcttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacctggaagctagcgagagcttccttcatagaagtcaagacatgcatctggccgaaatctcacactctatggagtaatggagtcttggaaagtgaaatgataatcccaaagatatatggaggaccaatatctcagcacaactacagaccagggtatttcacacaaacagcagggccatggcacctaggcaagttggaattggattttgacttgtgtgaaggtaccacagttgttgtggatgagcattgtggaaatcgaggtccatctctcagaactacaacagtcacaggaaagataatccatgaatggtgttgcagatcctgcacgttaccccccttacgcttcagaggagaagacggatgttggtatggcatggaaatcagaccagttaaggagaaggaggagaacctagttaggtcaatggtctctgcagggtcaggagaagtggacagtttttcattaggaatactatgcgtatcaataatgattgaagaagtgatgagatccagatggagtagaaagatgctgatgactggaacactagctgttttcctccttcttataatgggacaactgacatggaatgatctgattaggttatgcatcatggttggagctaatgcttcagacaggatggggatgggaacaacgtacctagccttgatgggtactttcaaaatgagaccaatgttcgctgttgggctattatttcgcagactaacatccagagaagttcttcttctcacgattggattaagcctggtggcatccgtggagctaccaaattctttggaggagctaggggatggacttgcaatgggtatcatgatgttaaaattattgactgaatttcagccacaccagctatggaccaccttactgtccctgacatttatcaaaacaactctctcattggattatgcatggaagacaatggctatggtactgtcaatcgtatctctctttcctttatgtctgtccacgacctcccaaaaaacaacatggcttccggtgctgttaggatcttttggatgcaaaccattaaccatgtttctcataacagaaaacaaaatctggggaaggaaaagttggcccctcaatgaaggaattatggctattggaatagtcagtattctactaagttcactcctcaaaaatgatgtgcccttggccggcccactaatagctggaggcatgctaatagcatgttatgtcatatctggaagctcagccgatttatcattggagaaagcggctgagatatcctgggaagaagaagcagaacactctggtacctcacataacatattagtagaggtccaagatgatggaactatgaaaataaaagatgaagagagggatgacacactcaccatactcctcaaagcaactctgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcctgcaaagaggactgttgggcaggtcccaggtaggagtgggagttttccaagacggcgtgtttcacacaatgtggcacgtcaccaggggagctgtcctcatgtaccaagggaagaggctggaaccaagctgggccagtgtaaaaaaggacttgatctcatatggaggaggttggaggtttcaaggatcatggaacactggagaagaagtgcaggtgatagctgttgaaccaggaaaaaaccccaaaaatgtacagacaacgccgggtacctttaagactcccgaaggcgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaagaagggcctctaccagagattgaggacgaggtgtttaagaaaagaaacttaacaataatggacctgcatccaggatcaggaaaaacaagaagatatcttccagccatagtccgtgaggccataaaaaggaaactgcgcacgttaatattggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatctccagtgagagttcccaattacaacatgattatcatggatgaagcacattttaccgatccagccagcatagcggccagagggtacatctcaacccgagtgggcatgggtgaagcagctgcgatttttatgacagccacccccccaggatcggtggaggcctttccacagagcaatgcagttattcaagatgaggaaagagacattcctgagagatcatggaactcaggctacgactggatcactgattttccaggtaaaacaatctggtttgttccaagcattaaatcaggaaatgacattgccaactgtttaagaaagaacggaaaacgggtgatccaattgagcagaaaaacttttgacactgagtaccagaaaacaaaaaacaatgactgggactatgttgtcacaacagacatttccgaaatgggggcaaacttccgggctgacagggtaatagacccaaggcggtgcttgaaaccggtaatactaaaagatggtccagagcgcgtcattctagcaggaccgatgccagttactgtggccagcgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggaatacagactacggggagaagcaaggaaaacgttcgtggagctcatgagaagaggagatctaccagtttggctatcctacaaagtcgcctcagaaggttttcagtactctgacagaaggtggtgctttgatggggaaaggaacaaccaggtgttggaggagaacatggacgtggagatctggacaaaggaaggagaaagaaagaaattgcgaccccgctggttggatgccagaacatactctgatccactggccctgcgcgagtttaaagagtttgcagcaggaagaagaagtatctcaggtgacctaatattggaaatagggaaacttccacaacatttgacgctaagagcccagaatgctctggataacttggtcatgttgcacaattccgaacaaggaggaaaagcctatagacatgctatggaggaactaccagacaccatagaaacattgatgctcctagctttgatagctgtgctgactggtggagtgacgctgttcttcctatcaggaaaaggtctagggaaaacatccattggcctgctctgtgtcatggcctcaagcgcactgttatggatggccaatgtggagccccattggatagcggcctccatcatactggagttctttctgatggtgctgctcattccagagccagacagacagcgcactccacaggacaaccagctagcatatgtggtgataggtttgttattcatgatactgacagtggcagccaatgagatgggattattggaaactacaaagaaagacctggggattggccatgtagccgctgaaaaccaccaccatgctacaatgctggacgtagacctacgtccagcttcagcctggaccctctatgcagtggccacaacagttatcactcccatgatgaggcacacaattgaaaatacaacggcaaacatttccctaacagccattgcaaatcaggcagccatattgatgggacttgataagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaagaggacagcggccggaataatgaaaaatccaaccgtagacgggattgttgcaatagacctggatcctgtggtttatgatgcaaaatttgaaaaacagctaggccaaataatgttactgatactttgtacatcacagattctcttgatgcggaccacatgggccttgtgtgaatccatcacactggctactgggcccttgaccactctctgggagggatctccaggaaaattctggaataccacgatagcagtgtccatggcaaacatcttcaggggaagttatctagcaggagcaggtctggccttctcattaatgaaatctctaggaggaggtaggagaggtacaggagctcaaggggaaacactgggagagaaatggaaaagacagttaaaccaactgagcaagtcagaattcaacacctacaaaaggagtgggattatggaggtggacagatccgaagccaaagagggattgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagttacactctggaaaagatgtattttttacaccacctgagaaatgtgatacccttctgtgtgatattggtgagtcatctccgaatccaactatagaagaaggaagaacgttacgtgtcttaaagatggtggaaccatggctcagaggaaaccaattctgcataaaaatcctaaatccttacatgccaagtgtggtagaaactctggagcaaatgcaaaggaaacacggagggatgctagtgagaaacccactctcaagaaattccacccatgaaatgtactgggtttcatgtggaacgggaaacattgtgtcggcagtgaacatgacatccagaatgctactgaatcgattcacaatggctcataggaagccaacatatgaaaaagatgtggacttaggcgctggaacaagacatgtggcagtggaaccagaggtagccaacctagatatcattggccagaggatagagaatataaaaaatgaacacaagtcaacatggcattatgatgaagacaatccatacaaaacatgggcctatcatggatcatatgaggtcaagccatcaggatcagcctcatctatggtgaatggcgtggtgagattgctcacaaaaccatgggatgttattcccatggtcacacaaatagctatgactgataccacacccttcggacaacagagagtgtttaaagagaaagttgacacgcgcacaccaagagcaaaacgaggcacagcacaaattatggaggtgacagccaagtggttatggggtttcctttctagaaacaaaaaacctagaatttgcacaagagaggagttcacaaaaaaggttaggtcaaacgcagcaataggagcagtgttcgttgatgaaaaccaatggaactcagcaaaagaagcagtggaagacgaaaggttttgggatctcgtgcacagagaaagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctagagttcgaggcccttggtttcatgaatgaagatcactggttcagtagagagaattcactcagcggggtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatctttaagctgacctaccagaacaaggtggtgagggtgcaaagaccagctaaaaatggaaacgtgatggatgttatatccagacgtgatcagagaggaagtggacaggtcggaacttatggcttaaatactttcaccaatatggaagtccaactaataagacaaatggagtctgaaggaatctttttacccagcgaactggaaaccccaaatctagctgagagagttcttgactggttggaaaaacatggcgccgaaaggctgaaaagaatggcgattagcggagatgattgtgtggtaaaaccaattgatgacaggttcgcaacagccctaatagctctgaatgacatgggaaaagtaagaaaagacataccgcagtgggaaccttcaaaaggatggaatgactggcagcaagtgcctttctgttcacaccatttccaccagctgatcatgaaggatgggagggaaatagtggtgccatgccgcaaccaagatgaacttgtgggcagggctagagtatcacaaggcgccggatggagcttgagagaaactgcttgcctaggtaagtcatacgcacaaatgtggcagctgatgtacttccacaggagagacctgagactagcggctaatgctatctgttcagctgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcccgagggggcactctggtaa

SEQ ID NO: 5561 - RNA, 9879 nt, synthetic construct
  misc_feature 1..9879: note = derived and/or modified CDS sequence (wt) from DENV-1__FJ687426__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaactgaaacgtggatgtcctctgaaggcgcttggaaacagatacaaagagtggagacttgggccctgagacacccaggattcacggtgatagccctttttctagcgcatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctactaacgtgtgctaagttcaagtgtgtgacaaaactggaaggaaagatagttcaatatgaaaacttgaaatattcagtaatagtcaccgtccacactggagaccagcatcaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacttaccactgccttggacctcgggagcttcaacatcacaagagacttggaacagacaagatttgctggtgacatttaagacagctcatgcaaagaagcaggaagtagtcgtattaggatcacaagaaggagcaatgcacactgcgttgaccggagcgacagaaattcaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaactcagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctctcgatgacgtgcattgcagttggcctagtaacactatacctaggagtcatggttcaggcggattcaggatgcgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaaccacatcttacttgaaaatgacatgaaattcacagtggttgtaggagatgttgctgggatcttggctcaaggaaaaaaaatgattaggccacaacccatggaatacaaatactcgtggaaaagctggggaaaggctaaaatcataggggcagatgtacagaactccaccttcatcattgacggcccaaacaccccagaatgccctgatgaccaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaggagcctctttcatagaagttaaaacatgtatttggccaaaatcccacactctatggagcaatggagttctggaaagtgaaatgataattccaaagatctatggaggaccaatatctcagcataactacagaccaggatatttcacacaaacggcagggccgtggcacctaggcaagttggaactggattttgatttgtgtgagggtaccacagtcgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacagaatggggatgggaacgacgtacctagctctgatggccacttttaaaatgagaccaatgtttgctgtagggctattattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgctttccttgcactatgcatggaagacaatggctatggtactgtcaattgtatctctcttccccttatgcctgtccacgacctcccagaaaacaacatggcttccggtgctattgggatctcttggatgcaaaccattaaccatgtttcttatagcagaaaacaaaatctggggaaggaaaagttggcccctcaatgaagggatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagatctgatctcatatggaggaggttggaggcttcaaggatcctggaacacgggagaagaagtgcaggtgattgctgttgaaccagggaaaaaccccaaaaatgtacaaacagcgccgggcacctttaagacccctgaaggtgaagttggagccattgccctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaagtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaagcgctcaagggaatgccaataaggtaccaaacaacagcagtgaagagtgaacacacaggaaaagagatagttgacctcatgtgtcacgccactttcaccatgcgcctcctgtctcccgtgagagtccccaattacaacatgattatcatggatgaagcacatttcaccgatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtctggtttgttccaagcattaaagcaggaaatgacattgccaactgcttaagaaagaatggaaaacgagtgattcaattgagcaggaaaacctttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggagaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatactagaaatagggaaacttccacaacacttgacgcaaagggcccagaatgccttggacaacctggtcatgttgcacaactccgaacaaggaggaagagcctatagacatgcaatggaagaactgccagacaccatagaaacgttgatgctcctagctttgatagctgtgttaactggtggagtgacgctgttcttcctatcaggaaagggcctagggaaaacatctatcggcctactctgcgtgatggcttcaagcgtactgctatggatggccagtgtggagccccattggatagcggcctccatcatactggagttcttcctgatggtgttgcttattccagagccagacagacaacgcactccgcaggacaaccagctggcatatgtggtgataggtttattattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccattgatggaattgttgcaatagatttggaccctgtggtttatgatgcaaaatttgagaaacaactaggtcaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttataccacctgagaaatgtgatacccttttgtgtgatattggtgagtcctctccaaacccaactatagaggaaggaagaacgctacgcgttctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgaccggttctgggaccttgtgcacagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggacttcacaaacttggatatatactcagagacatatcaaagattccagggggaaacatgtatgcagatgacacagccggatgggatacaaggataacagaggatgacctccagaatgaggccaaaattactgacatcatggaacccgaacatgccctactggctaagtcaatcttcaagctaacctaccaaaataaggtggtaagggtacagagaccagcaaaaaatggaaccgtgatggatgtcatatccagacgtgaccagagaggaagtggccaggttggaacttatggcttaaacactttcaccaacatggaagcccagctgataagacaaatggagtctgagggaatcttttcacccaacgaattagagaccccaaatttagccgagagagttctcgactggctggaaaaatatggcgtcgaaaggctgaaaagaatggcaatcagcggagatgactgcgtagtgaaaccaattgatgataggttcgcgacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccgtatatccagttgggaagatgttccatatctaggaaaaagggaagatcaatggtgtggatctctgataggcttaacagcaagggccacctgggccaccaacatacaagtggccataaaccaagtgagaagactaattgggaatgagaattattcagattacatgacatcaatgaagagattcaagaacgagagtgaacccgaaggggcactctggtga

SEQ ID NO: 5562 - RNA, 9879 nt, synthetic construct
  misc_feature 1..9879: note = derived and/or modified CDS sequence (wt) from DENV-1__FJ687428__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaactgaaacgtggatgtcctctgaaggcgcttggaaacagatacaaagagtggagacttgggccctgagacacccaggattcacggtgatagccctttttctagcgcatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctactaacgtgtgctaagttcaagtgtgtgacaaaactggaaggaaagatagttcaatatgaaaacttgaaatattcagtaatagtcaccgtccacactggagaccagcatcaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacttaccactgccttggacctcgggagcttcaacatcacaagagacttggaacagacaagatttgctggtgacatttaagacagctcatgcaaagaagcaggaagtagtcgtattaggatcacaagaaggagcaatgcacactgcgttgaccggagcgacagaaattcaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaactcagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaagggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctctcgatgacgtgcattgcagttggcctagtaacactatacctaggagtcatggttcaggcggattcaggatgcgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaaccacatcttacttgaaaatgacatgaaattcacagtggttgtaggagatgttgctgggatcttggctcaaggaaaaaaaatgattaggccacaacccatggaatacaaatactcgtggaaaagctggggaaaggctaaaatcataggggcagatgtacagaactccaccttcatcattgacggcccaaacaccccagaatgccctgatgaccaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaggagcctctttcatagaagttaaaacatgtatttggccaaaatcccacactctatggagcaatggagttctggaaagtgaaatgataattccaaagatctatggaggaccaatatctcagcataactacagaccaggatatttcacacaaacggcagggccgtggcacctaggcaagttggaactggattttgatttgtgtgagggtaccacagtcgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacagaatggggatgggaacgacgtacctagctctgatggccacttttaaaatgagaccaatgtttgctgtagggctattattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgctttccttgcactatgcatggaagacaatggctatggtactgtcaattgtatctctcttccccttatgcctgtccacgacctcccagaaaacaacatggcttccggtgctattgggatctcttggatgcaaaccactaaccatgtttcttatagcagaaaacaaaatctggggaaggaaaagttggcccctcaatgaagggatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcaaaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagatctgatctcatatggaggaggttggaggcttcaaggatcctggaacacgggagaagaagtgcaggtgattgctgttgaaccagggaaaaaccccaaaaatgtacaaacagcgccgggcacctttaagacccctgaaggtgaagttggagccattgccctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaagtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaagcgctcaagggaatgccaataaggtaccaaacaacagcagtgaagagtgaacacacaggaaaagagatagttgacctcatgtgtcacgctactttcaccatgcgcctcctgtctcccgtgagagtccccaattacaacatgattatcatggatgaagcacatttcaccgatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtctggtttgttccaagcattaaagcaggaaatgacattgccaactgcttaagaaagaatggaaaacgagtgattcaattgagcaggaaaacctttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggagaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatactagaaatagggaaacttccacaacacttgacgcaaagggcccagaatgccttggacaacctggtcatgttgcacaactccgaacaaggaggaagagcctatagacatgcaatggaagaactgccagacaccatagaaacgttgatgctcctagctttgatagctgtgttaactggtggagtgacgctgttcttcctatcaggaaagggcctagggaaaacatctatcggcctactctgcgtgatggcttcaagcgtactgctatggatggccagtgtggagccccattggatagcggcctccatcatactggagttcttcctgatggtgttgcttattccagagccagacagacaacgcactccgcaggacaaccagctggcatatgtggtgataggtttattattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccattgatggaattgttgcaatagatttggaccctgtggtttatgatgcaaaatttgagaaacaactaggtcaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttataccacctgagaaatgtgatacccttttgtgtgatattggtgagtcctctccaaacccaactatagaggaaggaagaacgctacgcgttctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagagcataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgaccggttctgggaccttgtgcacagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggacttcacaaacttggatatatactcagagacatatcaaagattccagggggaaacatgtatgcagatgacacagccggatgggatacaaggataacagaggatgacctccagaatgaggccaaaattactgacatcatggaacccgaacatgccctactggctaagtcaatcttcaagctaacctaccaaaataaggtggtaagggtacagagaccagcaaaaaatggaaccgtgatggatgtcatatccagacgtgaccagagaggaagtggccaggttggaacttatggcttaaacactttcaccaacatggaagcccagctgataagacaaatggagtctgagggaatcttttcacccaacgaattagagaccccaaatttagccgagagagttctcgactggctggaaaaatatggcgtcgaaaggctgaaaagaatggcaatcagcggagatgactgcgtagtgaaaccaattgatgataggttcgcgacagccttaacagctctgaatgatatgggaaaagtaagaaaagatataccacaatgggaaccttcaaaaggatggaatgattggcaacaagtgcccttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccgtatatccagttgggaagatgttccatatctaggaaaaagggaagatcaatggtgtggatctctgataggcttaacagcaagggccacctgggccaccaacatacaagtggccataaaccaagtgagaagactaattgggaatgagaattattcagattacatgacatcaatgaagagattcaagaacgagagtgaacccgaaggggcactctggtga

SEQ ID NO: 5563 - RNA, 9879 nt, synthetic construct
  misc_feature 1..9879: note = derived and/or modified CDS sequence (wt) from DENV-1__FJ687429__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaactgaaacgtggatgtcctctgaaggcgcttggaaacagatacaaagagtggagacttgggccctgagacacccaggattcacggtgatagccctttttctagcgcatgccataggaacatccatcacccagaaagggattattttcattttgttaatgctggtaacaccatccatggccatgcgatgcgtgggaataggcagcagggacttcgtggaaggactgtcaggagcaacttggatagatgtggtactggaacatggaagttgcatcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctactgacgtgtgctaagttcaagtgtgtgacaaaactggaaggaaagatagttcaatatgaaaacttgaaatattcagtaatagtcaccgtccacactggagaccagcatcaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacttaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaattcaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaactcagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctctcgatgacgtgcattgcagttggcctagtaacactatacctaggagtcatggttcaggcggattcaggatgcgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaaccacatcttacttgaaaatgacatgaaattcacagtggttgtaggagatgttgctgggatcttggctcaagggaaaaaaatgattaggccacaacccatggaatacaaatactcgtggaaaagctggggaaaggctaaaatcataggggcagatgtacagaactccaccttcatcattgacggcccaaacaccccagaatgccctgatgaccaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatttggccaaaatcccacactctatggagcaatggagttctggaaagtgaaatgataattccaaagatctatggaggaccaatatctcagcataactacagaccaggatatttcacacaaacggcagggccgtggcacctaggcaagttggaactggattttgatttgtgtgagggtacaacagtcgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacagaatggggatgggaacgacgtacctagctctgatggccacttttaaaatgagaccaatgtttgctgtagggctattattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggctatggtactgtcaattgtatctctcttccccttatgcctatccacgacctcccagaaaacaacatggcttccggtgctattgggatctcttggatgcaaaccattaaccatgtttcttatagcagaaaacaaaatctggggaaggaaaagttggcccctcaatgaagggatcatggctgttggaatagtcagcatcctactaagttcactcctcaaaaatgatgtgccgctagctgggccactaatagctggaggcatgctaatagcatgttatgttatatctggaagctcagccgacctatcattagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcacctttaagacccctgaaggtgaagttggagccattgccctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaagtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaagcgctcaagggaatgccaataaggtaccaaacaacagcagtgaagagtgaacacacaggaaaagagatagttgacctcatgtgtcacgccactttcaccatgcgcctcctgtctcccgtgagagtccccaattacaacatgattatcatggatgaagcacatttcaccgatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtctggtttgttccaagcattaaagcaggaaatgacattgccaactgcttaagaaagaatggaaaacgagtgattcaattgagcaggaaaacctttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggagaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatactagaaatagggaaacttccacaacacttgacgcaaagggcccagaatgccttggacaacctggtcatgttgcacaactccgaacaaggaggaagagcctatagacatgcaatggaagaactgccagacaccatagaaacgttgatgctcctagctttgatagctgtgttaactggtggagtgacgctgttcttcctatcaggaaagggcctagggaaaacatctatcggcctactctgcgtaatggcttcaagcgtactgctatggatggccagtgtggagccccattggatagcggcctccatcatactggagttcttcctgatggtgttgcttattccagagccagacagacaacgcactccgcaggacaaccagctggcatatgtggtgataggtttattattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaatcaggcagctatattgatgggacttgacaaaggatggccaatatcgaagatggacataggagttccacttctcgccttggggtgctattcccaggtgaatccactgacgctgacagcggcggtgctgatgctagtggctcattacgccataattggacctggactgcaagcaaaagccactagagaagctcaaaaaaggacagcggccggaataatgaaaaatccaaccattgatggaattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttataccacctgagaaatgtgatacccttttgtgtgatattggtgagtcctctccaaacccaactatagaggaaggaagaacgctacgcgttctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgaccggttctgggaccttgtgcacagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggacttcacaaacttggatatatactcagagacatatcaaagattccagggggaaacatgtatgcagatgacacagccggatgggatacaaggataacagaggatgacctccagaatgaggccaaaattactgacatcatggaacccgaacatgccctactggctaagtcaatcttcaagctaacctaccaaaataaggtggtaagggtacagagaccagcaaaaaatggaaccgtgatggatgtcatatccagacgtgaccagagaggaagtggccaggttggaacttatggcttaaacactttcaccaacatggaagcccagctgataagacaaatggagtctgagggaatcttttcacccaacgaattagagaccccaaatttagccgagagagttctcgactggctggaaaaatatggcgtcgaaaggctgaaaagaatggcaatcagcggagatgactgcgtagtgaaaccaattgatgataggttcgcgacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccgtatatccagttgggaagatgttccatatctaggaaaaagggaagatcaatggtgtggatctctgataggcttaacagcaagggccacctgggccaccaacatacaagtggccataaaccaagtgagaagactaattgggaatgagaattattcagattacatgacatcaatgaagagattcaagaacgagagtgaacccgaaggggcactctggtga

SEQ ID NO: 5564 - RNA, 9879 nt, synthetic construct
  misc_feature 1..9879: note = derived and/or modified CDS sequence (wt) from DENV-1__FJ850068__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaactgaaacgtggatgtcctctgaaggcgcttggaaacagatacaaagagtggagacttgggccctgagacacccaggattcacggtgatagccctttttctagcgcatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctactaacgtgtgctaagttcaagtgtgtgacaaaactggaaggaaagatagttcaatatgaaaacttgaaatattcagtaatagtcaccgtccacactggagaccagcatcaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacttaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaattcaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaactcagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctctcgatgacgtgcattgcagttggcctagtaacactatacctaggagtcatggttcaggcggattcaggatgcgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaaccacatcttacttgaaaatgacatgaaattcacagtggttgtaggagatgttgctgggatcttggctcaaggaaaaaaaatgattaggccacaacccatggaatacaaatactcgtggaaaagctggggaaaggctaaaatcataggggcagatgtacagaactccaccttcatcattgacggcccaaacaccccagaatgccctgatgaccaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaggagcctctttcatagaagttaaaacatgtatttggccaaaatcccacactctatggagcaatggagttctggaaagtgaaatgataattccaaagatctatggaggaccaatatctcagcataactacagaccaggatatttcacacaaacggcagggccgtggcacctaggcaagttggaactggattttgatttgtgtgagggtaccacagtcgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacagaatggggatgggaacgacgtacctagctctgatggccacttttaaaatgagaccaatgtttgctgtagggctattattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggctatggtactgtcaattgtatctctcttccccttatgcctgtccacgacctcccagaaaacaacatggcttccggtgctattgggatctcttggatgcaaaccattaaccatgtttcttatagcagaaaacaaaatctggggaaggaaaagttggcccctcaatgaagggatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcacctttaagacccctgaaggtgaagttggagccattgccctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaagtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaagcgctcaagggaatgccaataaggtaccaaacaacagcagtgaagagtgaacacacaggaaaagagatagttgacctcatgtgtcacgccactttcaccatgcgcctcctgtctcccgtgagagtccccaattacaacatgattatcatggatgaagcacatttcaccgatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtctggtttgttccaagcattaaagcaggaaatgacattgccaactgcttaagaaagaatggaaaacgagtgattcaattgagcaggaaaacctttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggagaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatactagaaatagggaaacttccacaacacttgacgcaaagggcccagaatgccttggacaacctggtcatgttgcacaactccgaacaaggaggaagagcctatagacatgcaatggaagaactgccagacaccatagaaacgttgatgctcctagctttgatagctgtgttaactggtggagtgacgctgttcttcctatcaggaaagggcctagggaaaacatctatcggcctactctgcgtgatggcttcaagcgtactgctatggatggccagtgtggagccccattggatagcggcctccatcatactggagttcttcctgatggtgttgcttattccagagccagacagacaacgcactccgcaggacaaccagctggcatatgtggtgataggtttattattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccattgatggaattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttataccacctgagaaatgtgatacccttttgtgtgatattggtgagtcctctccaaacccaactatagaggaaggaagaacgctacgcgttctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgaccggttctgggaccttgtgcacagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggacttcacaaacttggatatatactcagagacatatcaaagattccagggggaaacatgtatgcagatgacacagccggatgggatacaaggataacagaggatgacctccagaatgaggccaaaattactgacatcatggaacccgaacatgccctactggctaagtcaatcttcaagctaacctaccaaaataaggtggtaagggtacagagaccagcaaaaaatggaaccgtgatggatgtcatatccagacgtgaccagagaggaagtggccaggttggaacttatggcttaaacactttcaccaacatggaagcccagctgataagacaaatggagtctgagggaatcttttcacccaacgaattagagaccccaaatttagccgagagagttctcgactggctggaaaaatatggcgtcgaaaggctgaaaagaatggcaatcagcggagatgactgcgtagtgaaaccaattgatgataggttcgcgacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccgtatatccagttgggaagatgttccatatctaggaaaaagggaagatcaatggtgtggatctctgataggcttaacagcaagggccacctgggccaccaacatacaagtggccataaaccaagtgagaagactaattgggaatgagaattattcagattacatgacatcaatgaagagattcaagaacgagagtgaacccgaaggggcactctggtga

SEQ ID NO: 5565 - RNA, 9879 nt, synthetic construct
  misc_feature 1..9879: note = derived and/or modified CDS sequence (wt) from DENV-1__FJ687430__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcaacaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcacaaactggcgagcaccgacgagacaaacgttccgtcgcactggccccacacgtgggacttggtttggaaacaagaaccgaaacgtggatgtcctctgaaggcgcttggaaacagatacaaaaagtggagacttgggccctgagacacccaggattcacggtgatagccctttttctagcacatgccataggaacatccatcacccagaaagggattattttcattttgttaatgctggtaacaccatccatggccatgcgatgcgtggggataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccactgactcaagatgcccaacacaaggagaagccacactggtggaagaacaagacgcgaactttgtgtgtcgacgaacgtttgtggacagaggctggggcaacggctgtgggctcttcggaaaaggaagcctaataacgtgtgctaagttcaagtgtgtgacaaaactggaaggaaagatagtgcaatatgaaaatttgaaatattcagtaatagtcaccgtccacactggagaccagcaccaggtgggaaatgaaagcacagaacatgggacaactgcaactataacacctcaagctcctacaacggaaatacagctgaccgactacggagctctcacattggattgttcacctagaacaggactagactttaatgaaatggtgttgttgacaatgaaagaaaaatcatggctagtccacaaacaatggtttttagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccattctagtgcagattaaatacgaaggaacagatgcaccatgcaagatccctttttcgacccaagatgaaaaaggagtaacccagaatgggagattgataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattggtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacactatacttaggagtcatggttcaggcggattcaggatgtgtaattaattggaaaggtagagaactcaaatgtggaagcggcatttttgtcaccaatgaagttcacacttggacagagcaatacaaatttcaagctgactccccaaagagactatcagcagccattgggaaggcatgggaggagggtgtgtgtggaattcgatcagcaactcgtctcgagaacatcatgtggaagcaaatatcaaatgaactgaaccacatcttacttgaaaatgacatgaaattcacagtggttgtaggagatgttgctgggatcttggctcaagggaaaaagatgattaggccacaacccatggaatacaaatactcgtggaaaagctggggaaaggctaaaatcataggggcagatgtacagaacgccaccttcatcatcgacggcccaaacaccccagaatgccctgatgaccaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggagaagtggacagcttttcactgggactgttatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttcagacaagatggggatgggaacgacgtacctagctctgatggccacttttaaaatgagaccaatgtttgctgtagggctattattccgcagactaacatccagagaagttcttcttctaacaattggactgagtctagtggcatctgtggagttaccaaattccttggaggagctgggggatggacttgcaatgggcattatgatcttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggccgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgttagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccaggcacctttaagacccctgaaggtgaagttggagctattgccctagattttaaacccggcacatctggatctcccatcgtgaacagagaaggaaaaatagtaggtctttatggaaatggagtagtgacaacaagtggaacctacgtcagtgccatagctcaagctaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcccgagagatcatggaactcaggctatgagtggatcactgacttcccaggtaaaacagtttggtttgttccaagcattaaatcaggaaatgacattgccaactgcttaagaaagaatggaaaacgggtgattcaattgagcaggaaaacctttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgttattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgacaatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacatttgacgcaaagggcccagaatgccttggacaacctggttatgttgcacaactccgaacaaggaggaagagcctatagacatgcactggaagaactgccagacaccatagaaacgttgatgctcctagctttgatagctgtgttaactggtggagtgacgctgttcttcctatcaggaaggggcctagggaaaacatctattggcctactctgcgtgatggcttcaagcgtactgctatggatggccagtgtggaaccccattggatagcggcctccatcatattggagttcttcctgatggtgctgctcattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgcctcaatgctggacgtagacttacacccagcttcagcctggaccctctatgcagtggccacaacgattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactaacgctgacagcggcggtattgatgctagtggctcactacgccataattggacctggactgcaagcaaaagctactagagaagctcaaaaaaggacagcggccggaataatgaaaaatccaaccgttgatggaattgttgcaatagatttggaccctgtggtttatgatgcaaaatttgagaaacaactaggtcaaataatgttgttgatactatgcacatcacagatcctcttgatgcgaactacatgggccttgtgcgaatccatcacactggctactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaagggaggacctggacatgaagaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcagatgcaaagaaaacatggaggaatgctagtgcgaaatccactttcaagaaattctactcatgaaatgtattgggtttcatgcggaacaggaaacattgtgtcagcagtaaacatgacatccagaatgttgttaaatcgtttcacaatggctcacaggaaaccaacatatgaaagagacgtggacttaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaacagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaaaccaagaatttgtacgagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcataaacagggaaaatgtgccacgtgtgtttacaacatgatggggaagagagagaaaaaactaggagagttcggaaaggcaaaaggaagtcgtgcaatatggtacatgtggttgggagcacgctttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccttactggctaagtcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagctcagttgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5566 - RNA, 9879 nt, synthetic construct
  misc_feature 1..9879: note = derived and/or modified CDS sequence (wt) from DENV-1__FJ687432__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcaacaggtgtcaacatgtgcacccttatagcgatggatttgggagagttatgtgaggacacaatgacttacaaatgccctcgaattactgaggcggaaccagatgacgttgattgttggtgcaatgccacagacacatgggtgacctatggaacatgttcacaaactggcgagcaccgacgagacaaacgttccgtcgcactggccccacacgtgggacttggtttggaaacaagaaccgaaacgtggatgtcctctgaaggcgcttggaaacagatacaaaaagtggagacttgggccctgagacacccaggattcacggtgatagccctttttctagcacatgccataggaacatccatcacccagaaagggattattttcattttgttaatgctggtaacaccatccatggccatgcgatgcgtggggataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccactgactcaagatgcccaacacaaggagaagccacactggtggaagaacaagacgcgaactttgtgtgtcgacgaacgtttgtggacagaggctggggcaacggctgtgggctcttcggaaaaggaagcctaataacgtgtgctaagttcaagtgtgtgacaaaactggaaggaaagatagtgcaatatgaaaatttgaaatattcagtaatagtcaccgtccacactggagaccagcaccaggtgggaaatgaaagcacagaacatgggacaactgcaactataacacctcaagctcctacaacggaaatacagctgaccgactacggagctctcacattggattgttcacctagaacaggactagactttaatgaaatggtgttgttgacaatgaaagaaaaatcatggctagtccacaaacaatggtttttagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccattctagtgcagattaaatacgaaggaacagatgcaccatgcaagatccctttttcgacccaagatgaaaaaggagtaacccagaatgggagattgataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattggtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacactatacttaggagtcatggttcaggcggattcaggatgtgtaattaattggaaaggtagagaactcaaatgtggaagcggcatttttgtcaccaatgaagttcacacttggacagagcaatacaaatttcaagctgactccccaaagagactatcagcagccattgggaaggcatgggaggagggtgtgtgtggaattcgatcagcaactcgtctcgagaacatcatgtggaagcaaatatcaaatgaactgaaccacatcttacttgaaaatgacatgaaattcacagtggttgtaggagatgttgctgggatcttggctcaagggaaaaagatgattaggccacaacccatggaatacaaatactcgtggaaaagctggggaaaggctaaaatcataggggcagatgtacagaacgccaccttcatcatcgacggcccaaacaccccagaatgccctgatgaccaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggagaagtggacagcttttcactgggactgttatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttcagacaggatggggatgggaacgacgtacctagctctgatggccacttttaaaatgagaccaatgtttgctgtagggctattattccgcagactaacatccagagaagttcttcttctaacaattggactgagtctagtggcatctgtggagttaccaaattccttggaggagctgggggatggacttgcaatgggcattatgatcttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggccgttggaatagtcagcatcctattaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgttagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccaggcacctttaagacccctgaaggtgaagttggagctattgccctagattttaaacccggcacatctggatctcccatcgtgaacagagaaggaaaaatagtaggtctttatggaaatggagtagtgacaacaagtggaacctacgtcagtgccatagctcaagctaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcccgagagatcatggaactcaggctatgagtggatcactgacttcccaggtaaaacagtttggtttgttccaagcattaaatcaggaaatgacattgccaactgcttaagaaagaatggaaaacgggtgattcaattgagcaggaaaacctttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgttattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgacaatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacatttgacgcaaagggcccagaatgccttggacaacctggttatgttgcacaactccgaacaaggaggaagagcctatagacatgcactggaagaactgccagacaccatagaaacgttgatgctcctagctttgatagctgtgttaactggtggagtgacgctgttcttcctatcaggaaggggcctagggaaaacatctattggcctactctgcgtgatggcttcaagcgtactgctatggatggccagtgtggaaccccattggatagcggcctccatcatattggagttcttcctgatggtgctgctcattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgcctcaatgctggacgtagacttacacccagcttcagcctggaccctctatgcagtggccacaacgattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactaacgctgacagcggcggtattgatgctagtggctcactacgccataattggacctggactgcaagcaaaagctactagagaagctcaaaaaaggacagcggccggaataatgaaaaatccaaccgttgatggaattgttgcaatagatttggaccctgtggtttatgatgcaaaatttgagaaacaactaggtcaaataatgttgttgatactatgcacatcacagatcctcttgatgcgaactacatgggccttgtgcgaatccatcacactggctactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaagggaggacctggacatgaagaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgttaaatcgtttcacaatggctcacaggaaaccaacatatgaaagagacgtggacttaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaacagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaaaccaagaatttgtacgagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcataaacagggaaaatgtgccacgtgtgtttacaacatgatggggaagagagagaaaaaactaggagagttcggaaaggcaaaaggaagtcgtgcaatatggtacatgtggttgggagcacgctttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccttactggctaagtcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagctcagttgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5567 - RNA, 9879 nt, synthetic construct
  misc_feature 1..9879: note = derived and/or modified CDS sequence (wt) from DENV-1__JQ922547__SS-prME
  source 1..9879: mol_type = other RNA
tccgtgaccatgctccttatgctgctgcccacagccctggcgttccatctgacgacacgagggggagagccgcatatgatagttagcaagcaggaaagaggaaagtcacttttgttcaagacctctgcaggtgtcaacatgtgcacccttattgcgatggatttgggagagttgtgtgaggacacaatgacctacaaatgcccccggatcactgaggcggaaccagatgacgttgactgttggtgcaatgccacggacacatgggtgacctatggaacgtgttctcaaactggcgaacaccgacgagacaaacgttccgtcgcattggccccacacgtggggcttggcctagaaacaagagccgaaacgtggatgtcctctgaaggcgcttggaaacagatacaaaaagtagagacttgggctctgagacacccaggattcacagtgatagccctttttctagcacatgccataggaacatccatcacccagaaagggatcattttcattttactgatgctggtaacaccatctatggccatgcgatgtgtgggaataggcaacagagacttcgtggaaggactgtcaggagcaccttgggtggatgtggtactggaacatggaagttgcgtcaccaccatggcaaaaaataaaccaacactggacattgaactcttgaagacggaggtcacaaaccctgcagttctgcgtaaactgtgtattgaagctaaaatatcaaacaccaccaccgattcgagatgtccaacacaaggagaagccacactggtggaagaacaagacgcgaactgtgtgtgccgacgaacgttcgtggacagaggctggggcaatggctgtgggctattcggaaaaggtagtctaataacgtgtgccaagtttaagtgtgtgacaaaactagaaggaaagatagttcaatatgaaaacttaaaatattcagtgatagtcaccgtccacactggagatcagcaccaggtgggaaatgagaccacaacccatggaacaactgcaaccataacacctcaagctcccacgtcggaaatacagctgaccgactacggagcccttacactagattgttcacctagaacagggctagattttaacgagatggtgttgctgacaatgaaagaaaaatcatggcttgtccacaaacaatggtttctagacttaccactgccttggacctctggggcttcaacatcccaagagacttggaacagacaagatttactggtcacatttaagacagctcatgcaaagaagcaggaagtggtcgtactaggatcacaagaaggagcaatgcacactgcgctgactggagcgacagaaatccaaacgtcaggaacgacaacaattttcgcaggacacctaaaatgcagactaaaaatggacaaactaactttaaaagggatgtcatatgtgatgtgcacaggctcattcaagttagagaaagaagtggctgagacccagcatggaactgttctggtgcaggttaaatatgaaggaacagacgcaccatgcaagatccccttttcaacccaagatgagaaaggagcaacccagaatgggagattaataacagccaaccccatagtcactgacaaagaaaaaccagtcaatattgaggcagaaccaccctttggtgagagctacatcgtggtaggagcaggtgaaaaagctttgaaactaagctggttcaagaaaggaagcagcatagggaaaatgcttgaagcaactgcccgaggagcacgaaggatggccatcctgggagacaccgcatgggacttcggttctataggaggagtgttcacgtctatgggaaaactggtacaccaggtttttggaactgcatatggagttttgtttagcggtgtttcttggaccatgaaaataggaatagggattctgctgacatggctaggattaaattcaaggaacacgtccctttcgatgatgtgcatcgcagttggcatggtcacactgtacctaggagtcatggttcaggcagattcgggatgtgtaatcaattggaagggcagagaacttttatgtggaactggcatttttgtcactaatgaggtccacacttggacagatccatacaaattccaggctgacccctccaatagactatcacccatcattgggaaggcgtgtgtaatccgtgtgtgtggaatacgatcagccactcgtctcgagaatatcatgtggaaacaaatatcaaatgaattgaaccacatcctactcgaaaatgacatgaaatttacagtggtcgtgggagatgttagtggaatcttggcccaaggggaaaaaatgattaggccacaacccatggaacacaaatactcgtggaaaagctggggaaaagctaaaatcataggagcggatgtacagaacaccaccttcatcatcgacggcccaaacaccccagaatgccctgataatcaaagagcatggaatatctgggaagtagaggattatggatttgggattttcacgacaaacatatggttgaaattgcgtgactcctacacccaagtatgtgaccaccggctaatgtcagctgccatcaaggacagcaaggcagtccatgctgacatggggtactggatagaaagtgaaaagaacgagacctggaagttggcgagagcctcctttatagaagttaagacatgcacctggccaaaatcccacactctatggagcaatggagttctggaaagtgaaatgataatcccaaagatatatggaggaccaatatctcagcacaactacagaccaggatatttcacacaaacagcagggccgtggcacctaggcaagttggaactagatttcgatttttgtgaaggtaccacagttgttgtggatgaacattgtggaaatcgaggaccatctcttagaaccacaacagtcacaggaaaaataattcatgaatggtgctgtagatcttgtacgctacctcccttacgtttcaaaggggaagacgggtgttggtacggcatggaaatcagaccagtgaaggacaaggaagagaacctggtcaaatcaatggtctctgcagggtcaggagaagtggacagcttttcactaggactgctatgcatatcaataatgattgaagaggtgatgagatccagatggagcaaaaaaatgctgatggttggaacactggctgtgttcctccttcttataatgggacaattgacatggagtgatctgatcaggttatgtattatggttggagccaatgcttcagacaggatggggatgggaacaacgtacctagctttgatggccactttcaaaatgagaccaatgttcgctgtcgggctattatttcccaaactaacatctagagaagttcttcttcttacaattggcttgagcctggtggcatccgtggagctacccagttccctagaggagctgggggatggacttgcaaaaggcatcatgatgttaaaattattgacggattttcagtcacaccagctatgggctactctgctatccttgacatttatcaaaacaactttttcattgcactatgcatggaagacaatggctatggtactgtcaattgtatctctcttccctttatgtctgtccacgacctctcaaaaaacaacatggcttccggtgctgttgggatctcttggatgcaaaccactacccatgtttcttataacagaaaacaaaatctggggaaggaaaagttggcccctcaatgaaggaattatggctgtcggaatagttagtattctactaagttcacttctaaaaaatgatgtgccgctagccggcccactaatagctggaggcatgctagtagcatgttatgtcatatccggaagctcagctgatttatcactggagaaagcggctgaggtctcctgggaggaagaagcagaacactcaggtgcctcacacaacatactagtagaggttcaagatgatggaaccaggaagataaaagatgaagagagagatgacacgctcaccattctccttaaagcaactctgctggcagtttcaggggtgtacccaatgtcaataccagcaaccctttttgtgtggtatttttggcagaaaaagaatcagagatcaggagttggactcatcacacccagccccccagaagtggaaagagcagttctcgatgatggcatctatagaattttgcaaagaggactgttgggcaggtcccaagtaggagtaggagttttccaagaaggcgtgttccacacaatgtggcacgtcactaggggagctgtcctcatgtatcaagggaaaaggctggaaccaagctgggccagtgtcaaaaaagacttgatctcatatggaggaggttggaggtttcaaggatcctggaacacgggagaagaagtacaggtgattgctgttgaaccgggaagaaaccccaaaaatgtacaaacagccccgggtaccttcaagacccctgaaggcgaagttggagccatacccttagattttaaacccggcacatctggatctcccatcgtaaacagagagggaaaaatagtaggtctttatggaaatggagtggtgacaacaagcggaacttacgttagtgccatagctcgagctaaggcatcacaagaagggcctctaccagagattgaggacgaggtgtttaggaaaagaaacttaacaataatggacctacatccaggatcgggaaaaacaagaagataccttccagccatagtccgtgaggccataaaaaggaagctgcgcacgctaatcctagctcccacaagagttgtcgcttctgaaatggcagaggcgctcaagggagtgccaataaggtatcagacaacagcagtgaagagtgaacacacaggaaaggagatagttgaccttatgtgccatgccactttcaccatgcgcctcctgtctcccgtgagagttcccaattataacatgattatcatggatgaagcacattttaccgatccagccagcatagcagccagagggtacatctcaacccgagtgggtatgggtgaagcagctgcgatctttatgacagccactcccacaggatcggtggaggcctttccacagagcaatgcaattatccaagatgaggaaagagacattcctgagaggtcatggaactcaggctatgactggatcactgattttccaggtaaaacagtctggtttgttccaagcatcaaatcaggaaatgacattgccaactgtttaaaaaaaaacgggaaacgggtgatccaattgagcagaaaaacctttgacactgagtaccagaaaacaaaaaacaacgactgggactatgtcgtcacaacagacatttccgaaatgggagcaaacttccgggccgatagggtaatagacccaaggcggtgtctgaaaccggtaatactaaaagatggtccagagcgcgtcattctagccggaccgatgccagtgactgtggccagtgccgcccagaggagaggaagaattggaaggaaccaaaacaaggaaggtgatcaatatatttacatgggacagccttcaaacaatgatgaggaccacgctcattggacagaagcaaagatgctccttgacaatataaacacaccagaagggattatcccagccctctttgagccggagagagaaaagagtgcagcaatagacggggaatacagactgcggggtgaagcaaggaaaacgttcgtggagctcatgagaagaggagatctacctgtctggctatcctacaaagttgcctcagaaggcttccagtactccgacagaaggtggtgcttcgatggggaaaggaacaaccaggtgttggaggagaacaaggacgtggagatctggacaaaagaaggagaaagaaagaaactacgaacctgctggttggacgccagaacatactctgacccactggctctgcgcgagtttaaagagtttgcagcaggaagaagaagcgtctcaggtgacctaatattagaaatagggaaacttccacaacatttgacgcaaaaggcccagaaagctttggacaacttggtcatgttgcacaattccgaacaaggaggaaaagcctatagacatgctatggaagaactgccagacacaatagaaacgttgatgctcctagccttgatagctgtgttgactggtggagtgacgctgttcttcctatcaggaagaggtctaggaaaaacatccatcggcctactctgcgtgatggcctcaagcgtactgttatggatggccagtgtggagccccattggatagcagcctccatcatactggagttctttctgatggtgctgcttattccagagccagacagacagcgtactccacaggacaaccagctagcatatgtggtgataggtctgctattcatgatattgacagtggcagccaatgagatgggattactggaaaccacaaagaaagacctggggattggccatgtagctgctgaaaaccaccaccatgctacaatgctggacgtagacctacgtccagcttcagcctggaccctctatgcagtggccacaacaatcatcactcctatgatgagacacacaattgaaaacacaacggcaaatatttccctgacagccatcgcaaaccaagcagctatattgatgggacttgacaagggatggccaatatcgaagatggacataggagttccacttctcgccttggggtgctattcccaggtgaacccgctgacgctgacagcggcagtattgatgctagtggctcattacgccataattggacctggactgcaagcaaaagctactagagaagctcaaaaaagaacagcggctggaataatgaaaaatccaactgtcgacgggattgttgcaatagacttggatcccgtggtttacgatgcaaaatttgaaaaacagctaggccaaataatgttgttgatactttgcacatcacagattctcttgatgcggactacatgggccttgtgtgaatccatcacattggctactggacctctgaccactctttgggagggatctccaggaagattctggaacaccacaatagcggtatccatggcaaacattttcagggggagttatctagcaggagcaggtctggccttctcattaatgaaatctctaggaggaggtaggagaggcacgggagcccaaggggaaacactgggagaaaaatggaaaagacagctaaaccaactgagcaagtcagaattcaatacttacaaaaggagtgggattatggaggtggatagatccgaagccaaagagggactgaaaagaggagaaacaaccaaacacgcagtatcgagaggaacggccaaactgaggtggttcgtggagaggaaccttgtgaaaccagaagggaaagtcatagacctcggttgtggaagaggtggctggtcatattattgcgctgggctgaagaaagtcacagaagtgaaaggatacacaaaaggaggaccgggacatgaggaaccaatcccaatggcgacctatggatggaacctagtaaagctacactccggaaaagatgtattttttataccacctgagaaatgtgacacccttttgtgtgatattggtgagtcctctccgaacccaactatagaagaaggaagaacgttacgtgttctgaaaatggtggaaccatggctcagaggaaaccaattttgcataaaaattttaaatccctatatgccgagtgtggtagaaactctggaacaaatgcaaagaaaacatggaggaatgctagtgcgaaacccactctcaagaaattccacccatgaaatgtactgggtttcatgtggaacaggaaacattgtgtcagcagtaaacatgacatctaggatgttgctaaatcggttcacaatggctcacaggaagccaacatatgaaagagacgtggacttaggcgctggaacgagacatgtggcagtagaaccagaggtagccaacctagacatcattggccagaggatagagaatataaaaaatgaacataagtcaacatggcattatgatgaggacaatccatacaaaacatgggcctatcatggatcatatgaggttaagccatcaggatcggcctcatccatggtcaatggcgtggtgagattgctcaccaaaccatgggatgttatccccatggtcacacaaatagctatgactgacaccacaccctttggacaacagagggtgtttaaagagaaagttgacacgcgcacaccaaaagcaaaacgtggcacagcacaaattatggaagtgacagccaggtggttatggggtttcctttctagaaacaaaaaacccagaatttgcacaagagaggagtttacaagaaaagttaggtcaaacgcagctattggagcagtgttcgttgatgaaaatcaatggaactcagcaaaagaagcagtggaagacgaacggttctgggaccttgtgcacagagagagggagcttcataaacaggggaaatgtgccacgtgtgtctacaataagatggggaagagagagaaaaaattaggagagttcggaaaggcaaaaggaagtcgtgcaatatggtacatgtggttgggagcacgcttcctagagttcgaagcccttggtttcatgaatgaagatcactggttcagtagagagaattcactcagtggagtggaaggagaaggactccacaaacttggatacatactcagagacatatcaaggattccagggggaaacatgtatgcagatgacacagccggatgggacacaagaataacagaggatgatctccagaatgaggctaaaatcactgacatcatggagcccgagcatgccctgttggccacgtcaatctttaagctgacctaccaaaataaggtggtaagggtgcagagaccagcaaaaaatggaaccgtgatggatgctatatccagacgtgaccagagaggaagtggacaggttggaacttatggcttaaacactttccttcacaaggaggcccaactgataagacaaatggagtttgagggaatctttttacccagcgaattggaaaccccaaatctagccggaagagttctcgactggttggaacaatatggtgtcgaaaggctgaaaagaatggcaatcagcggagatgactgtgtggtgaaaccaattgatgacaggttcgcaacagccttaacagctttgaatgacatgggaaaagtaagaaaagacataccacaatgggaaccttcaaaaggatggggtgattggcaacaagtgcctttctgttcacaccacttccaccagctaattatgaaggatgtgagggagatagtggtgccatgccgcaaccaagatgaacttgtggggagggccagagtatcacaaggcgccggatggagcctgagagaaaccgcatgcctaggcaagtcatatgcacaaatgtggcagctgatgtatttccacaggagagacttgagactggcggctaacgccatctgttcagccgttccagttgattgggtcccaaccagccgcaccacctggtcgatccatgcccatcaccaatggatgacaacagaagacatgttatcagtatggaatagggtctggatagaggaaaacccatggatggaggataagactcatgtgtccagttgggaagatgttccatacctagggaaaagggaagatcagtggtgtggatccttgataggcttaacagcaagggccacctgggccactaatatacaagtggccataaaccaagtgagaaggctcattgggaatgagaattatctagattacatgacatcaatgaagagattcaagaatgagagtgatcccgaaggggcactctggtaa

SEQ ID NO: 5568 - RNA, 9879 nt, synthetic construct
  misc_feature 1..9879: note = derived and/or modified CDS sequence (wt) from DENV-1__EU482567__SS-prME
  source 1..9879: mol_type = other RNA
tctgtgaccatgcttctcatgctgctgcccacagccctggcgttccatttgactacacgagggggagagccacacatgatagtcagtaagcaggaaagaggaaagtcactgttgttcaagacctctgcaggcatcaacatgtgcactctcattgcgatggatttgggagagttatgcgaggacacaatgacctacaaatgcccccggatcactgaggcggaaccagatgacgttgactgctggtgcaatgccacagacacatgggtgacctacgggacgtgttctcaaaccggcgaacaccgacgagacaaacgttccgtggcactggccccacacgtgggacttggtctagagacaagaaccgaaacatggatgtcctctgaaggtgcctggaaacaaatacaaaaagtggagacttgggctttgagacacccaggattcacggtgacagccctttttttagcacatgccataggaacatccattactcagaaagggatcattttcattttgctgatactagtaacaccatcaatggccatgcgatgtgtgggaataggcaacagagacttcgttgaaggactgtcaggagcaacgtgggtggacgtggtattggagcatggaagctgcgtcaccaccatggcaaaagataaaccaacattggacattgaactcttgaagacggaggtcacaaaccctgccgtcttgcgcaaactgtgcattgaagctaaaatatcaaacaccaccaccgattcaaggtgtccaacacaaggagaggccacactggtggaagaacaagactcgaactttgtgtgtcgacgaacgtttgtggacagaggctggggtaatggctgcggactatttggaaaaggaagcctactgacgtgtgctaagttcaagtgtgtgacaaaactagaaggaaagatagttcaatatgaaaacttaaaatattcagtgatagtcactgtccacactggggaccagcaccaggtgggaaacgagactacagaacatggaacaattgcaaccataacaccccaagctccaacgtcggaaatacagctgactgactacggagccctcacattggactgctcgcctagaacagggctggactttaatgagatggtgctattgacaatgaaagaaaaatcatggcttgtccacaaacaatggtttctagacttaccactgccttggacttcaggagcttcaacatctcaagagacttggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacacctgaaatgcagactaaaaatggataaactgactttaaaagggatgtcatatgtaatgtgcacaggctcatttaagctagagaaggaagtggctgagacccagcatggaactgttctagtgcaggttaaatacgaaggaacagatgcgccatgcaagatccctttttcggcccaagatgagaaaggagtgacccagaatgggagattgataacagccaaccccatagtcactgacaaagaaaaaccagtcaacattgagacagaaccaccttttggtgagagctacatcgtggtaggggcaggtgaaaaagctttgaaactgagctggttcaagaaagggagcagcatagggaaaatgttcgaagcaactgcccgaggagcacgaaggatggctatcctgggagacaccgcatgggactttggctctataggaggagtgttcacatcagcgggaaaattggtacaccaggtttttggagccgcatatggggttctattcagcggagtttcttggaccatgaaaataggaatagggattctgctgacatggttgggattaaattcaaggagcacgtcactttcgatgacgtgcattgcggttggcatggtcacactgtacctaggagtcgtggttcaagcggactcgggatgtgtaatcaactggaagggcagagaactcaaatgtggaagtggtatttttgtcactaatgaagtccacacttggacagagcaatacaaattccaggctgactccccaaaaagactgtcagcagccattgggaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttagcccaagggaaaaaaatgattaggccacaacccatggaacatagatactcatggaaaagctggggaaaagccaaaatcataggagcagacatacagaatgccaccttcatcatcgacggcccagatactccagaatgccccgatgaccaaagagcgtggaacatttgggaagttgaagactatggttttggaattttcacgacaaacatatggctgaaattgcgcgactcctacacccaaatgtgtgaccaccggctaatgtcagctgccatcaaagacagcaaggcagtccatgctgacatggggtactggatagaaagcgaaaagaacgagacctggaagctagcgagagcctccttcatagaagtcaagacatgtatctggccgaaatcccacactctatggagtaatggagttttggaaagtgaaatgataatcccaaagatatatggaggaccaatatctcagcacaactacagaccagggtatttcacacaaacagcagggccgtggcacctaggcaagttggaattggattttgacttgtgtgaaggtaccacagttgttgtggatgaacattgtggaaatcgaggtccatctctcagaactacaacagtcacaggaaagataatccatgaatggtgttgcagatcctgcacgttaccccccttacgcttcagaggagaagacggatgttggtatggcatggaaatcagaccagttaaggagaaggaggaaaacctagttaggtcaatggtctctgcagggtcaggagaagtggacagtttttcactagggatactatgcgtatcaataatgattgaagaagtgatgagatccagatggagtagaaagatgctgatgactggaacactggctgtttttctccttcttataatgggacaactgacatggaaagatctgattaggttatgcatcatggttggagctaatgcttcagacaggatggggatgggaacaacgtacctggccttgatggccactttcaaaatgcgaccaatgttcgctgttgggctattatttcgcagactaacatccagagaagttcttcttctcacgattggattaagcctggtggcatccgtggagttaccaaattctttggaggagctaggggatggacttgcaatgggtatcatgatgttaaaattattgactgaatttcagccacaccagttatggaccaccttactgtctttgacattcatcaacacaactctttcattggattatgcatggaggacaatggctatggtgctatcaatcatatctctctttcctttatgtctgtctacgacctcccaaaaaacaacatggcttccggtgctgttaggatcttttggatgcaaaccattaaccatgtttcttataacagaaaacaaaatttggggaaggaaaagctggcccctcaatgaaggaattatggctattggaatagtcagcattctactaagttcactccttaaaaatgatgtgccgttagccggcccactaatagctggaggcatgctaatagcatgttatgtcatatccggaagttcagccgatttatcattggagaaagcagctgaggtatcctgggaagaagaagcagaacactctggtacctcacacaacatattagtagaggtccaagatgatggaaccatgaaaataaaagatgaagagagggatgacacactcaccatactcctcaaagcaactctgctggcagtctcaggagtgtacccaatgtcaataccagcaactcttttcgtgtggtatttttggcagaaaaagaaacaaagatcaggagtgttatgggacacacccagccctccggaagtggaaagagcagttcttgatgatggcatctatagaatcctgcaaagaggactgttgggcaggtcccaagtaggagtgggagttttccaagacggcgtcttccacacaatgtggcacgtcaccaggggagctgtccttatgtaccaagggaagaggttggaaccaagctgggccagtgtcaaaaaggacttgatctcatatggaggaggttggagatttcaaggatcatggaacacgggagaagaggtgcaggtgatagctgttgaaccaggaaaaaatcccaaaaatgtacagacaacgccgggtaccttcaagactcccgaaggcgaagttggagccatagctctagactttaaacccggcacatctggatctcccatcgtgaacagagagggaaaaatagtaggtctttatggaaatggagtggtgacaacaagtggaacctacgtcagtgccattgcccaagctaaaacatcacaagaagggcctctaccagagattgaggacgaggtgtttaagaaaaggaacttaacaataatggacctgcatccaggatcgggaaagacaagaagatatcttccagccatagtccgtgaggccataaaaaggaaactgcgcacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatctccagtgagagttcccaattacaacatgatcatcatggatgaagcacactttaccgatccagccagcatagcggccagagggtacatctcaactcgagtgggtatgggtgaagcagctgcgatctttatgacagccactcccccaggatcggtggaggcctttccacaaagcaatgcagttatccaagatgaggaaagagacattccagagagatcatggaactcaggctacgactggatcactgattttccaggtaaaacagtctggtttgttccaagcattaagtcaggaaatgacattgctaactgtttaagaaagaacggaaaacgggtgatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccagtgatactaaaagatggtccagagcgtgtcattctagccggaccgatgccagtgactgtggccagtgctgcccagagaagaggaagaattggaaggaaccaaaacaaggaaggtgatcagtacgtttatatgggacagcctttaaataatgatgaggaccacgctcattggacagaagcaaaaatgctccttgacaatataaacacaccagaagggatcattccagccctctttgagccagagagagaaaagagtgcagcaatagatggggagtacagactgcggggagaagcaaggaaaacattcgtggagctcatgagaagaggagatctaccagtttggctatcctacaaagttgcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccactggcccttcgtgagttcaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgctatggaggaactaccagacaccatagaaacattgatgctcctagctttgatagctgtgctgactggtggagtgacgctgttctttctatcaggaaaaggtctagggaaaacatccattggcctgctctgtgtgatggcctcaagcgcactgttatggatggccaatgtggagccacattggatagcggcctccatcatactagagttctttctgatggtgctgctcattccagagccagacagacagcgcactccacaggacaaccagctagcatacgtggtgataggtttgttattcatgatactgacagtggcagccaatgagatgggactattggaaaccacaaagaaagacctggggattggccatgttgccgccgaaaaccaccaccatgccacgatgctggacgtagacctacgcccagcttcagcctggaccctctatgcagtagccacaacagttatcactcccatgatgagacacacaattgaaaacacaacggcaaacatttccctgacggccattgcaaaccaggcagctatattgatgggacttgataagggatggccaatatcgaagatggacataggagttccacttctcgccttagggtgctattcccaggtgaacccattgacactgacagcagcggtgttgatgttagtggctcattatgccataattggaccaggactccaagcaaaggccactagagaagctcaaaaaaggacagcggccggaataatgaaaaatccaaccgtagacgggattgtcgcaatagacttggatcctgtggtttatgatgcaaaatttgaaaaacagttaggccaaataatgttactgatactttgcacatcacagattctcttgatgcggaccacatgggccttgtgtgaatccatcacactggctactggacccttgaccactctctgggagggatctccaggaaaattctggaataccacgatagcagtgtccatggcaaacatcttcaggggaagttatctagcaggagcaggtctggccttctcgttaatgaaatctttgggaggaggcaggagaggtacgggggctcaaggagaaacactgggagagaaatggaaaagacagttaaaccaactgagcaagtcagaattcaacacctacaaaaggagtgggattatggaggtggacagatccgaagccagagagggattaaaaagaggagaaacaaccaaacatgcagtgtcgagaggaacagccaaactgaggtggtttgtggagagaaacctcgtgaaaccagaagggaaagtcatagacctcggttgtggaagaggtggctggtcatattattgtgctgggctgaagaaagtcactgaagtcaagggttacacaaaaggaggacctggacatgaggaacctatcccaatggcgacctatggatggaacctagtaaagctatactctggaaaagatgtgttttttataccacctgagaaatgtgatacccttctgtgtgatataggagagtcctctccgaatccaactatagaagaaggaagaacgttacgtgttctaaagatggtagaaccatggctcagaggaaaccaattctgtataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcatcggccagaggatagagaatataaaaaatgaacacaagtcaacatggcattatgatgaagacaatccatacaaaacatgggcctatcatggatcatatgaggtcaaaccatcaggatcagcctcatctatggtgaatggcgtggtaagattgctcacaaaaccatgggatgtcatccccatggtcacacaaatagccatgaccgataccacacccttcggacaacagagagtgtttaaagagaaagtagacacgcgcacaccaagagcaaaacgaggcacagcacaaattatggaggtgacagccaagtggttatggggtttcctttccagaaacaaaaaacccagaatctgtacaagagaggagttcacaagaaaggttaggtcaaacgcagcaataggagcagtgttcgttgatgaaaaccaatggaactcagcaaaagaagcagtggaagacgaaaggttttggaatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctagagttcgaagcccttggtttcatgaatgaagatcactggttcagtagagagaattcatttagtggagtggaaggagaaggactgcacaaacttggatacatactcagagacatatcaaagatcccggggggaaatatgtatgcagatgacacagccggatgggacacaagaataacagaggatgatcttcaaaatgaggctaaaatcactgacatcatggagcctgaacacgctctattggctacgtcaatttttaagctgacctaccaaaacaaggtggtaagagtgcaaagaccagcaaaaaatggaaccgtgatggatgttatatccagacgagaccagagaggaagtgggcaagtcggaacctatggcttaaatactttcaccaatatggaggtccaactaataagacaaatggagtctgaaggaatctttttacccagcgaattggaaacccccaatctagctgagagagttcttgactggttggaaaaacatggcaccgaaaggctgaaaagaatggcaattagcggagatgattgtgtggtgaaaccagttgacgagaggtttgcaacagccttaatagctctgaatgacatgggaaaagtaagaaaagacataccgcagtgggaaccttcaaaaggatggaatgactggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctaagactagcggctaatgctatctgttcagctgtcccagttgactgggtcccaaccagccgcacaacctggtcaatccatgctcaccatcaatggatgacaacagaagacatgttatcagtgtggaatagggtttggatagaggaaaacccatggatggaggacaaaactcatgtatccagctgggaagaagtcccatacttagggaaaagggaagatcaatggtgtggatccctgataggcttgacagctagggccacttgggccactaacatacaagtagccataaaccaagtgagaaggctcatcgggaatgagaattatctagattacatgacatcaatgaagagattcaagaatgagagtgatcccgaaggggcactctggtaa

SEQ ID NO: 5569 - RNA, 9879 nt, synthetic construct
  misc_feature 1..9879: note = derived and/or modified CDS sequence (wt) from DENV-1__FJ390378__SS-prME
  source 1..9879: mol_type = other RNA
tctgtgaccatgctcctcatgctgctgcccacagccctggcgttccatttgactacacgagggggagagccacacatgatagttagtaagcaggaaagaggaaagtcactgttgtttaagacctctgcaggcatcaatatgtgcactctcattgcgatggatctgggagagttatgcgaggacacaatgacctacaaatgcccccggatcactgaggcggaaccagatgacgttgactgctggtgcaatgccacagacacatgggtgacctatgggacatgttctcaaaccggcgaacaccgacgagacaaacgttccgtggcactggccccacacgtgggacttggtctagaaacaagaaccgaaacatggatgtcctctgaaggtgcctggaaacaaatacaaaaagtggagacttgggctttgagacacccaggattcacggtgacagccctttttttagcacatgccataggaacatccattactcagaaagggatcattttcattttgctgatgctagtaacaccatcaatggccatgcgatgtgtgggaataggcaacagggacttcgttgaaggactgtcaggagcaacgtgggtggacgtggtattggagcatggaagctgcgtcaccaccatggcaaaagataaaccaacattggacattgaactcttgaagacggaggtcacaaaccctgccgtcttgcgcaaactgtgcattgaagctaaaatatcaaacaccaccaccgattcaaggtgtccaacacaaggagaggccacactggtggaagaacaagactcgaactttgtgtgtcgacgaacgtttgtggacagaggctggggtaatggctgcggactatttggaaaaggaagcctactgacgtgtgctaagttcaagtgtgtgacaaaactagaagggaagatagttcaatatgaaaacttaaaatattcagtgatagtcactgtccacactggggaccagcaccaggtgggaaacgagactacagaacatggaacaattgcaactataacacctcaagctcctacgtcggaaatacagctgactgactacggagccctcacattggactgctcacctagaacagggctggactttaatgagatggttctattgacaatgaaagaaaaatcatggcttgtccacaaacaatggtttctagacttaccactgccttggacttcaggagcttcaacatctcaagagacttggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacgatctttgcaggacacctgaaatgcagactaaaaatggataaactgactttaaaaggaatgtcatatgtaatgtgcacaggctcatttaagctagagaaggaagtggctgagacccagcatggaactgttctagtgcaggttaaatacgaaggaacagatgcgccatgcaagatccctttttcggcccaagatgagaaaggagtgacccagaatgggagattgataacagccaaccccatagtcactgacaaagaaaaaccagtcaacattgagacagaaccaccttttggtgagagctacatcgtggtaggggcaggtgaaaaagctttgaaactgagctggttcaagaaagggagcagcatagggaaaatgttcgaagcaactgcccgaggagcacgaaggatggctatcctgggagacaccgcatgggactttggctctataggaggagtgttcacatcagtgggaaaattggtacaccaggtttttggagccgcatatggggttctgttcagcggtgtttcttggaccatgaaaataggaatagggattctgctgacatggttgggattaaattcaaggagcacgtcactttcgatgacgtgcattgcggttggcatggtcacactgtacctaggagtcatggttcaagcggactcgggatgtgtaatcaactggaagggcagagaactcaaatgtggaagtggtatttttgtcactaatgaagtccacacttggacagagcaatacaaattccaggctgactccccaaaaagactgtcagcagccattgggaaggcatgggaagagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacatagatactcatggaaaagctggggaaaagccaaaatcataggagcagacatacagaatagcaccttcatcatcgacggcccagatactccagaatgccccgatgaccaaagagcgtggaacatttgggaagttgaagactatgggtttggaattttcacgacaaacatatggctgaaattgcgcgactcctacacccaaatgtgtgaccaccggctaatgtccgctgccatcaaagacagcaaagcagtccatgctgacatggggtactggatagaaagtgaaaagaacgagacctggaagctagcgagagcctccttcatagaagtcaagacatgtatctggccgaaatcccacactctatggagtaatggagttttggaaagtgaaatgataatcccaaagatatatggaggaccaatatctcagcacaactacagaccagggtatttcacacaaacagcagggccatggcacctaggcaagttggaattggatttcgacttgtgtgaaggtaccacagttgttgtggatgaacattgtggaaatcgaggcccatctctcagaaccacaacagtcacaggaaagataatccatgaatggtgttgcagatcctgcacgttaccccccttacgcttcagaggagaagacggatgttggtatggcatggaaatcagaccagttaaggagaaggaggaaaacctagttaggtcaatggtctctgcagggtcaggagaagtggacagtttttcactagggatactatgcgtatcaataatgattgaagaagtgatgagatccagatggagtagaaagatgctgatgactggaacattggctgttttcctccttcttataatgggacaactgacatggaatgacctgattaggttatgcatcatggttggagctaatgcttcagacaggatggggatgggaacaacgtacctggccttgatggctactttcaaaatgagaccaatgttcgctgttgggctactatttcgcagactaacatccagagaagttcttcttctcacgattggattaagcctggtagcatccgtggagttaccaaattctttggaggagctaggggatggacttgcaatgggtatcatgatgttaaaattattgactgaatttcagccacaccagttatggaccaccttactgtctttgacatttatcaaaacaactctttcattggattatgcatggaggacaatggctatggtgctgtcaatcgtatctctctttcctttatgtctgtctacgacctcccaaaaaacaacatggcttccggtgctgttaggatcttttggatgcaaaccattaaccatgtttcttataacagaaaacaaaatttggggaaggaaaagttggcccctcaatgaaggaattatggctattggaatagtcagcattctactaagttcactccttaaaaatgatgtgccgttggccggcccactaatagctggaggcatgctaatagcatgttatgtcatatccggaagctcagccgatttatcattggagaaagcggctgaggtatcctgggaagaagaagcagaacactctggtacctcacacaacatattagtagaggtccaagatgatggaactatgaaaataaaagatgaagagagggatgacacactcaccatactcctcaaagcaactctgctggcagtctcaggagtgtacccaatgtcaataccagcaactcttttcgtgtggtatttttggcagaaaaagaaacagagatcaggagtgttatgggacacacccagccctccggaagtggaaagagcagttcttgatgatggcatctatagaatcctgcaaagaggactgttgggcaggtcccaagtgggagtgggagttttccaggacggcgtgttccacacaatgtggcacgtcaccaggggagctgtccttatgtaccaagggaagaggttggaaccaagctgggccagtgtcaaaaaggacttgatctcatatggaggaggttggagatttcaaggatcatggaacacgggagaagaggtgcaggtgatagccgttgaaccaggaaaaaatcctaaaaatgtacagacaacgccgggtaccttcaagactcccgaaggcgaagttggagccatagctctagattttaaacccggcacatctggatctcccatcgtgaacagagagggaaaaatagtaggtctttatggaaatggagtggtgacaacaagtggaacctacgtcagtgccattgcccaagctaaaacatcacaagaagggcctctaccagagattgaggaggaggtgtttaagaaaaggaacttaacaataatggacctgcatccaggatcgggaaaaacaagaagatatcttccagccatagtccgtgaggccataaaaaggaaactgcgcacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatctccagtgagagttcccaattacaacatgattatcatggatgaagcacattttaccgatccagccagcatagcggccagagggtacatctcaactcgagtgggtatgggtgaagcagctgcgatctttatgacagccactcccccaggatcggtggaggcctttccacaaagtaatgcagttatccaagatgaggaaagagacattcctgagagatcatggaactcaggctacgactggatcactgattttccaggtaaaacagtctggtttgttccaagcattaagtcaggaaatgacattgctaactgtttaagaaagaacggaaaacgggtgatccaattgagcagaaaaacctttgacactgagtaccagaaaacaagaaacaatgactgggactatgttgtcacaacagacatttccgaaatgggggcaaatttccgggccgacagggtaatagacccaaggcggtgcttgaaaccagtgatactaaaagatggtccagagcgtgtcattctagccggaccgatgccagtgactgtggccagtgctgcccagagaagaggaagaattggaaggaaccaaaacaaggaaggtgatcagtacgtttatatgggacagcctttaaataatgatgaggatcacgctcattggacagaagcaaaaatgctccttgacaatataaacactccagaagggatcattccagccctctttgagccagagagagaaaagagtgcagcaatagatggagagtacagactgcggggagaagcaaggaaaacattcgtggagctcatgagaagaggagatctaccagtttggctatcctacaaagttgcctcagaaggtttccagtactccgacagaaggtggtgctttgacggggaaaggaacaaccaggtgttggaggagaacatggacgtggagatctggacaaaggaaggagaaaggaagaaattgcgaccccgctggttggatgccagaacatactctgatccactggcccttcgtgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgctatggaggaactaccagacaccatagaaacattgatgctcctagctttgatagctgtgctgactggtggagtgacgctgttcttcctatcaggaaaaggtctagggaaaacatccattggcctgctctgtgtgatggcctcaagcgcactgttatggatggccaatgtggagccacattggatagcggcctccatcatactagagttctttctgatggtgctgctcattccagagccagacagacagcgcactccacaggacaaccagctagcatacgtggtgataggtttgttattcatgatactgacagtggcagccaatgagatgggattattggaaaccacaaagaaagacctggggattggctatgtagccgccgaaaaccaacaccatgccacgatgctggacgtagacctacgcccagcttcagcctggaccctctatgcagtagccacaacagttatcactcccatgatgagacacacaattgaaaacacaacagcaaacatttccctgacagccattgcaaaccaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagttaggccaaataatgttactgatactttgtacatcacagattctcttgatgcggaccacatgggccctgtgtgaatccatcacactggccactggacccttgaccactctctgggagggatctccaggaaaattctggaataccacaatagcagtgtccatggcaaatatcttcaggggaagttatctagcaggagcaggtctggccttctcattaatgaaatctttgggaggaggcaggagaggtacgggggctcaaggagaaacactgggagagaaatggaaaagacagttaaaccaactgagcaagtcagaattcaacacctacaaaaggagtgggattatggaggtggacagatccgaagccaaagagggattaaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtcaagggatacacaaaaggaggacctggacatgaggaacctatcccaatggcgacctatggatggaacctagtaaagctatactctggaaaagatgtattttttacaccacctgagaaatgtgatacccttctgtgtgatataggagagtcctctccgaatccaactatagaagaaggaagaacgttacgtgttctaaagatggtagaaccatggctcagaggaaaccaattctgcataaaaattctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatgactcacaggaagccaacatatgaaagagacgtggacttaggcgctggaacaagacatgtggcagtggaaccagaggtagccaacctagatattattggccagaggatagagaatataaaaaatgaacacaagtcaacatggcattatgatgaagacaatccatacaaaacatgggcctatcatggatcatatgaggtcaaaccatcaggatcagcctcatctatggtgaatggcgtggtgagattgctcacaaaaccatgggatgtcatccccatggtcacacaaatagctatgaccgataccacacccttcggacaacagagagtgtttaaagagaaagtagatacgcgcacgccgagagcaaaacgaggcacagcacaaattatggaggtgacagccaagtggctatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggaacttcataaacagggaaaatgtgccacgtgtgtctacaacatgatggggaagagagagaaaaaattgggagagtttggaaaggcaaaaggaagtcgtgcaatatggtacatgtggctgggagcacgctttctagagttcgaagcccttggtttcatgaatgaagatcactggttcagtagagagaattcattcagtggagtggaaggagaaggactgcacaaacttggatacatactcagagacatatcaaagatcccggggggaaacatgtatgcagatgacacagccggatgggacacaagaataacagaggatgatcttcagaatgaggccaaaatcactgacatcatggagcctgaacacgctctattagctacgtcaatttttaagctgacctaccaaaacaaggtggtaagggtgcaaagaccagcaaaaaatggaaccgtgatggatgttatatccagacgagaccagagaggaagtgggcaggtcggaacttatggcttaaatactttcaccaatatggaggtccaactaataagacaaatggagtctgaaggaatctttttacccagcgaattggaaacccccaatctagctgagagagttcttaactggttggaaaaacatggcactgaaaggctgaaaagaatggcaattagcggagatgattgtgtggtgaaaccagttgatgacaggtttgcaacagccttaatagctctgaatgacatgggaaaagtaagaaaagacataccgcagtgggaaccttcaaaaggatggaatgactggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctaagactagcggctaatgctatctgttcagctgtcccagttgactgggttccaaccagccgcacaacctggtcaatccatgctcaccatcaatggatgacaacagaagatatgttatcagtgtggaatagggtttggatagaggaaaacccatggatggaggataaaactcatgtgtccagctgggaagaagtcccatacttagggaaaagggaagatcaatggtgtggatccctgataggcttgacagcgagggccacttgggccactaacatacaagtggccataaaccaagtgagaaggctcatcggaaatgagaattatctagattacatgacatcaatgaagagattcaagaatgagagtgatcccgaaggggcactctggtaa

SEQ ID NO: 5570 - RNA, 9879 nt, synthetic construct
  misc_feature 1..9879: note = derived and/or modified CDS sequence (wt) from DENV-1__FJ205872__SS-prME
  source 1..9879: mol_type = other RNA
tctgtgaccatgctcctcatgctgctgcccacagccctggcgttccatttgactacacgagggggagagccacacatgatagttagtaagcaggaaagaggaaagtcactgttgtttaagacctctgcaggcatcaatatgtgcactctcattgcgatggatctgggagagttatgcgaggacacaatgacctacaaatgcccccggatcactgaggcggaaccagatgacgttgactgctggtgcaatgccacagacacatgggtgacctatgggacatgttctcaaaccggcgaacaccgacgagacaaacgttccgtggcactggccccacacgtgggacttggtctagaaacaagaaccgaaacatggatgtcctctgaaggtgcctggaaacaaatacaaaaagtggagacttgggctttgagacacccaggattcacggtgacagccttttttttagcacatgccataggaacatccattactcagaaagggatcattttcattttgctgatgctagtaacaccatcaatggccatgcgatgtgtgggaataggcaacagggacttcgttgaaggactgtcaggagcaacgtgggtggacgtggtattggagcatggaagctgcgtcaccaccatggcaaaagataaaccaacattggacattgaactcttgaagacggaggtcacaaaccctgccgtcttgcgcaaactgtgcattgaagctaaaatatcaaacaccaccaccgattcaaggtgtccaacacaaggagaggccacactggtggaagaacaagactcgaactttgtgtgtcgacgaacgtttgtggacagaggctggggtaatggctgcggactatttggaaaaggaagcctactgacgtgtgctaagttcaagtgtgtgacaaaactagaagggaagatagttcaatatgaaaacttaaaatattcagtgatagtcactgtccacactggggaccagcaccaggtgggaaacgagactacagaacatggaacaattgcaactataacacctcaagctcctacgtcggaaatacagctgactgactacggagccctcacattggactgctcacctagaacagggctggactttaatgagatggttctattgacaatgaaagaaaaatcatggcttgtccacaaacaatggtttctagacttaccactgccttggacttcaggagcttcaacatctcaagagacttggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacgatctttgcaggacacctgaaatgcagactaaaaatggataaactgactttaaaaggaatgtcatatgtaatgtgcacaggctcatttaagctagagaaggaagtggctgagacccagcatggaactgttctagtgcaggttaaatacgaaggaacagatgcgccatgcaagatccctttttcggcccaagatgagaaaggagtgacccagaatgggagattgataacagccaaccccatagtcactgacaaagaaaaaccagtcaacattgagacagaaccaccttttggtgagagctacatcgtggtaggggcaggtgaaaaagctttgaaactgagctggttcaagaaagggagcagcatagggaaaatgttcgaagcaactgcccgaggagcacgaaggatggctatcctgggagacaccgcatgggactttggctctataggaggagtgttcacatcagtgggaaaattggtacaccaggtttttggagccgcatatggggttctgttcagcggtgtttcctggaccatgaaaataggaatagggattctgctgacatggttgggattaaattcaaggagcacgtcactttcgatgacgtgcattgcggttggcatggtcacactgtacctaggagtcatggttcaagcggactcgggatgtgtaatcaactggaagggcagagaactcaaatgtggaagtggtatttttgtcactaatgaagtccacacttggacagagcaatacaaattccaggctgactccccaaaaagactgtcagcagccattgggaaggcatgggaagagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacatagatactcatggaaaagctggggaaaagccaaaatcataggagcagacatacagaatagcaccttcatcatcgacggcccagatactccagaatgccccgatgaccaaagagcgtggaacatttgggaagttgaagactatgggtttggaattttcacgacaaacatatggctgaaattgcgcgactcctacacccaaatgtgtgaccaccggctaatgtccgctgccatcaaagacagcaaagcagtccatgctgacatggggtactggatagaaagtgaaaagaacgagacctggaagctagcgagagcctccttcatagaagtcaagacatgtatctggccgaaatcccacactctatggagtaatggagttttggaaagtgaaatgataatcccaaagatatatggaggaccaatatctcagcacaactacagaccagggtatttcacacaaacagcagggccatggcacctaggcaagttggaattggatttcgacttgtgtgaaggtaccacagttgttgtggatgaacattgtggaaatcgaggcccatctctcagaactacaacagtcacaggaaagataatccatgaatggtgttgcagatcctgcacgttaccccccttacgcttcagaggagaagacggatgttggtatggcatggaaatcagaccagttaaggagaaggaggaaaacctagttaggtcgatggtctctgcagggtcaggagaagtggacagtttttcactagggatactatgcgtatcaataatgattgaagaagtgatgagatccagatggagtagaaagatgctgatgactggaacattggctgttttcctccttcttataatgggacaactgacatggaatgacctgattaggttatgcatcatggttggagctaatgcttcagacaggatggggatgggaacaacgtacctggccttgatggctactttcaaaatgagaccaatgttcgctgttgggctactatttcgcagactaacatccagagaagttcttcttctcacgattggattaagcctggtagcatccgtggagttaccaaattctttggaggagctaggggatggacttgcaatgggtatcatgatgttaaaattattgactgaatttcagccacaccagttatggaccaccttactgtctttgacatttatcaaaacaactctttcattggattatgcatggaggacaatggctatggtgctgtcaatcgtatctctctttcctttatgtctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactccttaaaaatgatgtgccgttggccggcccactaatagctggaggcatgctaatagcatgttatgtcatatccggaagctcagccgatttatcattggagaaagcggctgaggtatcctgggaagaagaagcagaacactctggtacctcacacaacatattagtagaggtccaagatgatggaactatgaaaataaaagatgaagagagggatgacacactcaccatactcctcaaagcaactctgctggcagtctcaggagtgtacccaatgtcaataccagcaactcttttcgtgtggtatttttggcagaaaaagaaacagagatcaggagtgttatgggacacacccagccctccggaagtggaaagagcagttcttgatgatggcatctatagaatcctgcaaagaggactgttgggcaggtcccaagtgggagtgggagttttccaggacggcgtgttccacacaatgtggcacgtcaccaggggagctgtccttatgtaccaagggaagaggttggaaccaagctgggccagtgtcaaaaaggacttgatctcatatggaggaggttggagatttcaaggatcatggaacacgggagaagaggtgcaggtgatagccgttgaaccaggaaaaaatcctaaaaatgtacagacaacgccgggtaccttcaagactcccgaaggcgaagttggagccatagctctagattttaaacccggcacatctggatctcccatcgtgaacagagagggaaaaatagtaggtctttatggaaatggagtggtgacaacaagtggaacctacgtcagtgccattgcccaagctaaaacatcacaagaagggcctctaccagagattgaggaggaggtgtttaagaaaaggaacttaacaataatggacctgcatccaggatcgggaaaaacaagaagatatcttccagccatagtccgtgaggccataaaaaggaaactgcgcacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatctccagtgagagttcccaattacaacatgattatcatggatgaagcacattttaccgatccagccagcatagcggccagagggtacatctcaactcgagtgggtatgggtgaagcagctgcgatctttatgacagccactcccccaggatcggtggaggcctttccacaaagtaatgcagttatccaagatgaggaaagagacattcctgagagatcatggaactcaggctacgactggatcactgattttccaggtaaaacagtctggtttgttccaagcattaagtcaggaaatgacattgctaactgtttaagaaagaacggaaaacgggtgatccaattgagcagaaaaacctttgacactgagtaccagaaaacaagaaacaatgactgggactatgttgtcacaacagacatttccgaaatgggggcaaatttccgggccgatagggtaatagacccaaggcggtgcttgaaaccagtgatactaaaagatggtccagagcgtgtcattctagccggaccgatgccagtgactgtggccagtgctgcccagagaagaggaagaattggaaggaaccaaaacaaggaaggtgatcagtacgtttatatgggacagcctttaaataatgatgaggatcacgctcattggacagaagcaaaaatgctccttgacaatataaacactccagaagggatcattccagccctctttgagccagagagagaaaagagtgcagcaatagatggagagtacagactgcggggagaagcaaggaaaacgttcgtggagctcatgagaagaggagatctaccagtttggctatcctacaaagttgcctcagaaggtttccagtactccgacagaaggtggtgctttgacggggaaaggaacaaccaggtgttggaggagaacatggacgtggagatctggacaaaggaaggagaaaggaagaaattgcgaccccgctggttggatgccagaacatactctgatccactggcccttcgtgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgctatggaggaactaccagacaccatagaaacattgatgctcctagctttgatagctgcgctgactggtggagtgacgctgttcttcctatcaggaaaaggtctagggaaaacatccattggcctgctctgtgtgatggcctcaagcgcactgttatggatggccaatgtggagccacattggatagcggcctccatcatactagaattctttctgatggtgctgctcattccagagccagacagacagcgcactccacaggacaaccagctagcatacgtggtgataggtttgttattcatgatactgacagtggcagccaatgagatgggattattggaaaccacaaagaaagacctggggattggctatgtagccgccgaaaaccaacaccatgccacgatgctggacgtagacctgcgcccagcttcagcctggaccctctatgcagtagccacaacagttatcactcccatgatgagacacacaattgaaaacacaacagcaaacatttccctgacagccattgcaaaccaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacggcggccggaataatgaaaaatccaaccgtagacgggattgttgcaatagacttggatcctgtggtttatgatgcaaaatttgaaaaacagttaggccaaataatgttactgatactttgtacatcacagattctcttgatgcggaccacatgggccctgtgtgaatccatcacactggctactggacccttgaccactctctgggagggatctccaggaaaattctggaataccacgatagcagtgtccatggcaaacatcttcaggggaagttatctagcaggagcaggtctggccttctcgttaatgaaatctttgggaggaggcaggagaggtacgggggctcaaggagaaacactgggagagaaatggaaaagacagctaaaccaactgagcaagtcagaattcaacacctacaaaaggagtgggattatggaggtggacagatccgaagccaaagagggattaaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtcaagggatacacaaaaggaggacctggacatgaggaacctatcccaatggcgacctatggatggaacctagtaaagctatactctggaaaagatgtattttttacaccacctgagaaatgtgatacccttctgtgtgatataggagagtcctctccgaatccaactatagaagaaggaagaacgttacgtgttctaaagatggtagaaccatggctcagaggaaaccaattctgcataaaaattctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatgactcacaggaagccaacatatgaaagagacgtggacttaggcgctggaacaagacatgtggcagtggaaccagaggtagccaacctagatattattggccagaggatagagaatataaaaaatgaacacaagtcaacatggcattatgatgaagacaatccatacaaaacatgggcctatcatggatcatatgaggtcaaaccatcaggatcagcctcatctatggtgaatggcgtggtgagattgctcacaaaaccatgggatgtcatccccatggtcacacaaatagctatgaccgataccacacccttcggacaacagagagtgtttaaagagaaagtagatacgcgcacgccgagagcaaaacgaggcacagcacaaattatggaggtgacagccaagtggctatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggaacttcataaacagggaaaatgtgccacgtgtgtctacaacatgatggggaagagagagaaaaaattaggagagtttggaaaggcaaaaggaagtcgtgcaatatggtacatgtggctgggagcacgctttctagagttcgaagcccttggtttcatgaatgaagatcactggttcagtagagagaattcattcagtggagtggaaggagaaggactgcacaaacttggatacatactcagagacatatcaaagatcccggggggaaacatgtatgcagatgacacagccggatgggacacaagaataacagaggatgatcttcagaatgaggccaaaatcactgacatcatggagcctgaacacgctctattagctacgtcaatttttaagctgacctaccaaaacaaggtggtaagggtgcaaagaccagcaaaaaatggaaccgtgatggatgttatatccagacgagaccagagaggaagtgggcaggtcggaacttatggcttaaatactttcactaatatggaggtccaactaataagacaaatggagtctgaaggaatctttttacccagcgaattggaaacccccaatctagctgagagagttcttaactggttggaaaaacatggcactgaaaggctgaaaagaatggcaattagcggagatgattgtgtggtgaaaccagttgatgacaggtttgcaacagccttaatagctctgaatgacatgggaaaagtaagaaaagacataccgcagtgggaaccttcaaaaggatggaatgactggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctaagactagcggctaatgctatctgttcagctgtcccagttgactgggttccaaccagccgcacaacctggtcaatccatgctcaccatcaatggatgacaacagaagatatgttatcagtgtggaatagggtttggatagaggaaaacccatggatggaggataaaactcatgtgtccagctgggaagaagtcccatacttagggaaaagggaagaccaatggtgtggatccctgataggcttgacagcgagggccacttgggccactaacatacaagtggccataaaccaagtgagaaggctcatcggaaatgagaattatctagattacatgacatcaatgaagagattcaagaatgagagtgatcccgaaggggcactctggtaa

SEQ ID NO: 5571 - RNA, 9879 nt, synthetic construct
  misc_feature 1..9879: note = derived and/or modified CDS sequence (wt) from DENV-1__FJ205873__SS-prME
  source 1..9879: mol_type = other RNA
tctgtgaccatgctcctcatgctgctgcccacagccctggcgttccatttgaccacacgagggggagagccacacatgatagttagtaagcaggaaagaggaaagtcactgttgtttaagacctctgcaggcatcaatatgtgcactctcattgcgatggatttgggagagttatgcgaggacacaatgacctacaaatgcccccggatcactgaggcggaaccagatgacgttgactgctggtgcaatgccacagacacatgggtgacctatgggacatgttctcaaaccggcgaacaccgacgagacaaacgttccgtggcactggccccacacgtgggacttggtctagaaacaagaaccgaaacatggatgtcctctgaaggtgcctggaaacaaatacaaaaagtggagacttgggctttgagacacccaggattcacggtgacagccctttttttagcacatgccataggaacatccattactcagaaagggatcattttcattttgctgatgctagtaacaccatcaatggccatgcgatgtgtgggaataggcaacagggacttcgttgaaggactgtcaggagcaacgtgggtggacgtggtattggagcatggaagctgcgtcaccaccatggcaaaagataaaccaacattggacattgaactcttgaagacggaggtcacaaaccctgccgtcttgcgcaaactgtgtattgaagctaaaatatcaaacaccaccaccgattcaaggtgtccaacacaaggagaggccacactggtggaagaacaagactcgaactttgtgtgtcgacgaacgtttgtggacagaggctggggtaatggctgcggactatttggaaaaggaagcctactgacgtgtgctaagttcaagtgtgtgacaaaactagaaggaaagatagttcaatatgaaaacttaaaatattcagtgatagtcactgtccacactggggaccagcaccaggtgggaaacgagactacagaacatggaacaattgcaactataacacctcaagctcctacgtcggaaatacagctgactgactacggagccctcacattggactgctcacctagaacagggctggactttaatgagatggttctattgacaatgaaagaaaaatcatggcttgtccacaaacaatggtttctagacttaccactgccttggacttcaggagcttcaacatctcaagagacttggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacgatctttgcaggacacctgaaatgcagactaaaaatggataaactgactttaaaagggatgtcatatgtaatgtgcacaggctcatttaagctagagaaggaagtggctgagacccagcatggaactgttctagtgcaggttaaatacgaaggaacagatgcgccatgcaagatccctttttcggcccaagatgagaaaggagtgacccagaatgggagattgataacagccaaccccatagtcactgacaaagaaaaaccagtcaacattgagacagaaccaccttttggtgagagctacatcgtggtaggggcaggtgaaaaagctttgaaactgagctggttcaagaaagggagcagcatagggaaaatgttcgaagcaactgcccgaggagcacgaaggatggctatcctgggagacaccgcatgggactttggctctataggaggagtgttcacatcagtgggaaaattggtacaccaggtttttggagccgcatatggggttctgttcagcggtgtttcttggaccatgaaaataggaatagggattctgctgacatggttgggattaaattcaaggagcacgtcactttcgatgacgtgcattgcggttggcatggtcacactgtacctaggagtcatggttcaagcggactcgggatgtgtaatcaactggaaaggcagagaactcaaatgtggaagtggtatttttgtcaccaatgaagtccacacttggacagagcaatacaaattccaggctgactccccaaaaagactgtcagcagccattgggaaggcatgggaagagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacatagatactcatggaaaagctggggaaaagccaaaatcataggagcagacatacagaatagcaccttcatcatcgacggcccagatactccagaatgccccgatgaccaaagagcgtggaacatttgggaagttgaagactatgggtttggaattttcacgacaaacatatggctgaaattgcgcgactcctacacccaaatgtgtgaccaccggctaatgtccgctgccatcaaagacagcaaggcagtccatgctgacatggggtactggatagaaagtgaaaagaacgagacctggaagctagcgagagcctccttcatagaagtcaagacatgtatctggccgaaatcccacactctatggagtaatggagttttggaaagtgaaatgataatcccaaagatatatggaggaccaatatctcagcacaactacagaccagggtatttcacacaaacagcagggccatggcacctaggcaagttggaattggattttgacttgtgtgaaggtaccacagttgttgtggatgaacattgtggaaatcgaggcccatctctcagaactacaacagtcacaggaaagataatccatgaatggtgctgcagatcctgcacgttaccccccttacgcttcagaggagaagacggatgttggtatggcatggaaatcagaccagttaaggagaaggaggaaaacctagttaggtcaatggtctctgcagggtcaggagaagtggacagtttttcactagggatactatgcgtatcaataatgattgaagaagtgatgagatccagatggagtagaaagatgctgatgactggaacattggctgttttcctccttcttataatgggacaactgacatggaatgacctgattaggttatgcatcatggttggagctaatgcttcagacaggatggggatgggaacaacgtacctggccttgatggctactttcaaaatgagaccaatgttcgctgttgggctactatttcgcaaactaacatccagagaagttcttcttctcacgattggattaagcctggtggcatccgtggagttaccaaattctttggaggagctaggggatggacttgcaatgggtatcatgatgttaaaattattgactgaatttcagccacaccagttatggaccaccttactgtctttgacatttatcaaaacaactctttcattggattatgcatggaggacaatggctatggtgctgtcaatcgtatctctctttcctttatgtctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactccttaaaaatgatgtgccgttggccggcccactaatagctggaggcatgctaatagcatgttatgtcatatccggaagctcagccgatttatcattggagaaagcggctgaggtatcctgggaagaagaagcagaacattctggtacctcacacaacatattagtagaggtccaagatgatggaactatgaaaataaaggatgaagagagggatgacacactcaccatactcctcaaagcaactttgctggcagtctcaggagtgtacccaatgtcaataccagcaactcttttcgtgtggtatttttggcagaaaaagaaacagagatcaggagtgttatgggacacacccagccctccggaagtggaaagagcagttcttgatgatggcatctatagaatcctgcaaagaggactgttgggcaggtcccaagtaggagtgggagttttccaggacggcgtgttccacacaatgtggcacgtcaccaggggagctgtccttatgtaccaagggaagaggttggaaccaagctgggccagtgtcaaaaaggacttgatctcatatggaggaggttggagatttcaaggatcatggaacacgggagaagaggtgcaggtgatagccgttgaaccaggaaaaaatcctaaaaatgtacagacaacgccgggtaccttcaagactcccgaaggcgaagttggagctatagctctagattttaaacccggcacatctggatctcccatcgtgaacagagagggaaaagtagtaggtctttatggaaatggagtggtgacaacaagtggaacctatgtcagtgccattgcccaagctaaaacatcacaagaagggcctctaccagagattgaggaggaggtgtttaagaaaaggaacttaacaataatggacctgcatccaggatcgggaaaaacaagaagatatcttccagccatagtccgtgaggccataaaaaggaaactgcgcacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatctccagtgagagttcccaattacaacatgattatcatggatgaagcacattttaccgatccagccagcatagcggccagagggtacatctcaactcgagtgggtatgggtgaagcagctgcgatctttatgacagccactcccccaggatcggtggaggcctttccacaaagtaatgcagttatccaagatgaggaaagagacattcctgagagatcatggaattcaggctacgactggatcactgattttccaggtaaaacagtctggtttgttccaagcattaagtcaggaaatgacattgctaactgtttaagaaagaacggaaaacgggtgatccaattgagcagaaaaacctttgacactgagtaccagaaaacaagaaacaatgactgggactatgttgtcacaacagacatttccgaaatgggggcaaatttccgggccgacagggtaatagacccaaggcggtgcttgaaaccagtgatactaaaagatggtccagagcgtgtcattctagccggaccgatgccagtgactgtggccagtgctgcccagagaagaggaagaattggaaggaaccaaaacaaggaaggtgatcagtacgtttatatgggacagcctttaaataatgatgaggatcacgctcattggacagaagcaaaaatgctccttgacaatataaacacaccagaagggatcattccagccctctttgagccagagagagaaaagagtgcagcaatagatggggagtacagactgcggggagaagcaaggaaaacgttcgtggagctcatgagaagaggagatctaccagtttggctatcctacaaagttgcctcagaaggtttccagtactccgacagaaggtggtgctttgacggggaaaggaacaaccaggtgttggaggagaacatggacgtggagatctggacaaaggaaggagaaaggaagaaattgcgaccccgctggttggatgccagaacatactctgatccactggcccttcgtgagtttaaagagtttgcagcaggaagaagaagtgtctcaggtgacctaatattggaaatagggaaacttccacaacatttgacgctaagagcccagaatgctctggataacttggtcatgttgcacaattccgaacaaggagggaaagcctatagacatgctatggaggaactaccagacaccatagaaacattgatgctcctagctttgatagctgtgctgactggtggagtgacgctgttcttcctatcaggaaaaggtctagggaaaacatccattggcctgctctgtgtgatggcctcaagcgcactgttatggatggccaatgtggagccacattggatagcggcctccatcatactagagttctttctgatggtgctgctcattccagagccagacagacagcgcactccacaggacaaccagctagcatacgtggtgataggtttgttattcatgatactgacagtggcagccaatgagatgggattattggaaaccacaaagaaagacctggggattggccatgtagccgccgaaaaccaacaccatgccacgatgctggacgtagacctacgcccagcttcagcctggaccctctatgcagtagccacaacagttatcactcccatgatgagacacacaattgaaaacacaacagcaaacatttccctgacagccattgcaaaccaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagttaggccaaataatgttactgatactttgtacatcacagattctcttgatgcggaccacatgggccctgtgtgaatccatcacactggctactggacccttgaccactctctgggagggatctccaggaaaattctggaataccacgatagcagtgtccatggcaaacatcttcaggggaagttatctagcaggagcaggtctggccttctcgttaatgaaatctttgggaggaggcaggagaggtacgggggctcaaggagaaacactgggagagaaatggaaaagacagttaaaccaactgagcaagtcagaattcaacacctacaaaaggagtgggattatggaggtggacagatccgaagccaaagagggattaaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtcaagggatacacaaaaggaggacctggacatgaggaacctatcccaatggcgacctatggatggaacctagtaaagctatactctggaaaagatgtattttttacaccacctgagaaatgtgatacccttctgtgtgatataggagagtcctctccgaatccaactatagaagaaggaagaacgttacgtgttctaaagatggtagaaccatggctcagaggaaaccaattctgcataaaaattctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatgactcacaggaagccaacatatgaaagagatgtggacttaggcgctggaacaagacatgtggcagtggaaccagaggtagccaacctagatattattggccagaggatagagaatataaaaaatgaacacaagtcaacatggcattatgatgaagacaatccatacaaaacatgggcctatcatggatcatatgaggtcaaaccatcaggatcagcctcatctatggtgaatggcgtggtgagattgctcacaaaaccatgggatgtcatccccatggtcacacaaatagccatgaccgataccacacccttcggacaacagagagtgttcaaagagaaagtagatacgcgcacgccgagagcaaaacgaggcacagcacaaattatggaggtgacagccaagtggctatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggaactccataaacagggaaaatgtgccacgtgtgtctacaacatgatggggaagagagagaaaaaattgggagagtttggaaaggcaaaaggaagtcgtgcaatatggtacatgtggctgggagcacgctttctagagttcgaagcccttggtttcatgaatgaagatcactggttcagtagagagaattcattcagtggagtggaaggagaaggactgcacaaacttggatacatactcagagacatatcaaagatcccggggggaaacatgtatgcagatgacacagccggatgggacacaagaataacagaggatgatcttcagaatgaggccaaaatcactgacatcatggagcctgaacacgctctattagctacgtcaatttttaagctgacctaccaaaacaaggtggtaagggtgcaaagaccagcaaaaaatggaaccgtgatggatgttatatccagacgagaccagagaggaagtgggcaggtcggaacctatggcctaaacactttcaccaatatggaggtccaactaataagacaaatggagtctgaaggaatttttttacccagcgaattggaaacccccaatctagctgagagagttcttaactggttggaaaaacatggtactgaaaggctgaaaagaatggcaattagcggagatgattgtgtggtgaaaccagttgatgacaggtttgcaacagccttaatagctctgaatgacatgggaaaagtaagaaaagacataccgcagtgggaaccttcaaaaggatggaatgactggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctaagactagcggctaatgctatctgttcagctgtcccagttgactgggttccaaccagccgcacaacctggtcaatccatgctcaccatcaatggatgacaacagaagatatgttatcagtgtggaatagggtttggatagaggaaaacccatggatggaggataaaactcatgtatccagctgggaagaagtcccatacttaggaaaaagggaagatcaatggtgtggatccctgataggcttgacagcgagggccacttgggccactaacatacaagtagccataaaccaagtgagaaggcttatcggaaatgagaattatctagattacatgacatcaatgaagagattcaagaatgagagtgatcccgaaggggcactctggtaa

SEQ ID NO: 5572 - RNA, 9879 nt, synthetic construct
  misc_feature 1..9879: note = derived and/or modified CDS sequence (wt) from DENV-1__FJ390379__SS-prME
  source 1..9879: mol_type = other RNA
tctgtgaccatgctcctcatgctgctgcctacagccctggcgttccatttgaccacacgagggggagagccacacatgatagttagtaagcaggaaagaggaaagtcactgttgtttaagacctctgcaggcatcaatatgtgcactctcattgcgatggatttgggagagttatgcgaggacacaatgacctacaaatgcccccggatcactgaggcggaaccagatgacgttgactgctggtgcaatgccacagacacatgggtgacctatgggacatgttctcaaaccggcgaacaccgacgagacaaacgttccgtggcactggccccacacgtgggacttggtctagaaacaagaaccgaaacatggatgtcctctgaaggtgcctggaaacaaatacaaaaagtggagacttgggctttgagacacccaggattcacggtgacagccctttttttagcacatgccataggaacatccattactcagaaagggatcattttcattttgctgatgctagtaacaccatcaatggccatgcgatgtgtgggaataggcaacagggacttcgttgaaggactgtcaggagcaacgtgggtggacgtggtattggagcatggaagctgtgtcaccaccatggcaaaagataaaccaacattggacattgaactcttgaagacggaggtcacaaaccctgccgtcttgcgcaaactgtgcattgaagctaaaatatcaaacaccaccaccgattcaaggtgtccaacacaaggagaggccacactggtggaagaacaagactcgaactttgtgtgtcgacgaacgtttgtggacagaggctggggtaatggctgcggactatttggaaaaggaagcctactgacgtgtgctaagttcaagtgtgtgacaaaactagaaggaaagatagttcaatatgaaaacttaaaatattcagtgatagtcactgtccacactggggaccagcaccaggtgggaaacgagactacagaacatggaacaattgcaactataacacctcaagctcctacgtcggaaatacagctgactgactacggagccctcacattggactgctcacctagaacagggctggactttaatgagatggttctattgacaatgaaagaaaaatcatggcttgtccacaaacaatggtttctagacttaccactgccttggacttcaggagcttcaacatcccaagagacttggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacacctgaaatgcagactaaaaatggataaactgactttaaaagggatgtcatatgtaatgtgcacaggctcatttaagctagagaaggaagtggctgagacccagcatggaactgttctagtgcaggttaaatacgaaggaacagatgcgccatgcaaaatccctttttcggcccaagatgagaaaggagtgacccagaatgggagattgataacagccaaccccatagtcactgacaaagaaaaaccagtcaacattgagacagaaccaccttttggtgagagctacatcgtggtaggggcaggtgaaaaagctttgaaactgagctggttcaagaaagggagcagcatagggaaaatgttcgaagcaactgcccgaggagcacgaaggatggctatcctgggagacaccgcatgggactttggctctataggaggagtgttcacatcagtgggaaaattggtacaccaggtttttggagccgcatatggggttctgttcagcggtgtttcttggaccatgaaaataggaatagggatcctgctgacatggttgggattaaattcaaggagcacgtcactttcgatgacgtgcattgcggttggcatggtcacactgtacctaggagtcatggttcaagcggactcgggatgtgtaatcaactggaagggcagagaactcaaatgtggaagtggtatttttgtcactaatgaagtccacacttggacagagcaatacaaattccaggctgactccccaaaaagactgtcagcagccattgggaaagcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggagaaaaatgattaggccacaacccatggaacatagatactcatggaaaagctggggaaaagccaaaatcataggagcagacatacagaatagcaccttcatcatcgacggcccagatactccagaatgccccgatgaccaaagagcgtggaacatttgggaagttgaagactatgggtttggaattttcacgacaaacatatggctgaaattgcgcgactcctacacccaaatgtgtgaccaccggctaatgtccgctgccatcaaagacagcaaggcagtccatgctgacatggggtactggatagaaagtgaaaagaacgagacctggaagctagcgagagcctccttcatagaagtcaagacatgtatctggccgaaatcccacactctatggagtaatggagttttggaaagtgaaatgataatcccaaagatatatggaggaccaatatctcagcacaactacagaccagggtatttcacacaaacagcagggccgtggcacctaggcaagttggaattggattttgacttgtgtgaaggtaccacagttgttgtggatgaacattgtggaaatcgaggcccatctctcagaactacaacagtcacaggaaagataatccatgaatggtgttgcagatcctgcacgttaccccccttacgcttcagaggagaagacggatgttggtatggcatggaaatcagaccagttaaggagaaggaggaaaacctagttaggtcaatggtctctgcagggtcaggagaagtggacagtttttcactagggatactatgcgtatcaataatgattgaagaagtgatgagatccagatggagtagaaagatgctgatgactggaacattggctgttttcctccttcttataatgggacaactgacatggaatgacctgattaggttatgcatcatggttggagctaatgcttcagacaggatggggatgggaacaacgtacctggctttgatggctactttcaaaatgagaccaatgttcgctgttgggctactatttcgcagattaacatccagagaagttcttcttctcacgattggattaagcctggtggcatccgtggagttaccaaattctttggaggagctaggggatggacttgcaatgggtatcatgatgttaaaattattgactgaatttcagccacaccagttatggaccaccttactgtctttgacatttatcaaaacaactctttcattggattatgcatggaggacaatggctatggtgctgtcaatcgtatctctctttcccttatgtctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggccattggaatagtcagcattctactaagttcactccttaaaaatgatgtgccgttggccggcccactaatagctggaggcatgctaatagcatgttatgtcatatccggaagctcagccgatttatcattggagaaagcggctgaggtatcctgggaagaagaagcagaacactctggtacctcacacaacatattagtagaggtccaagatgatggaactatgaaaataaaagatgaagagagggatgacacactcaccatactcctcaaagcaactctgctggcaatctcaggagtgtacccaatgtcaataccagcaactcttttcgtgtggtatttttggcagaaaaagaaacagagatcaggagtgttatgggacacacccagccctccggaagtggaaagagcagttcttgatgatggcatctatagaatcctgcaaagaggactgttgggcaggtcccaagtgggagtgggagttttccaggacggcgtgttccacacaatgtggcacgtcaccaggggagctgtccttatgtaccaagggaagaggttggaaccaagctgggccagtgtcaaaaaggacttgatctcatatggaggaggttggagatttcaaggatcatggaacacgggagaagaggtgcaggtgatagccgttgaaccaggaaaaaatcctaaaaatgtacagacaacgccgggtaccttcaagactcccgaaggcgaagttggagccatagccctagattttaaacccggcacatctggatctcccatcgtgaacagagagggaaaaatagtaggtctttatggaaatggagtggtgacaacaagtggaacctacgtcagtgccattgcccaagctaaaacatcacaagaagggcctctaccagagattgaggaggaggtgtttaagaaaaggaacttaacaataatggacctgcatccaggatcgggaaaaacaagaagatatcttccagccatagtccgtgaggccataaaaaggaaactgcgcacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatctccagtgagagttcccaattacaacatgattatcatggatgaagcacattttaccgatccagccagcatagcggccagagggtacatctcaactcgagtgggtatgggtgaagcagctgcgatctttatgacagccactcccccaggatcggtggaggcctttccacaaagtaatgcagttatccaagatgaggaaagagacattcctgagagatcatggaactcaggctacgactggatcactgattttccaggtaaaacagtctggtttgttccaagcattaagtcaggaaatgacattgctaactgtttaagaaagaacggaaaacgggtgatccaattgagcagaaaaacctttgacactgagtaccagaaaacaagaaacaatgactgggactatgttgtcacaacagacatttccgaaatgggggcaaatttccgggccgacagggtaatagacccaaggcggtgcttgaaaccagtgatactaaaagatggtccagagcgtgtcattctagccggaccgatgccagtgactgtggccagtgctgcccagagaagaggaagaattggaaggaaccaaaacaaggaaggtgatcagtacgtttatatgggacagcctttaaataatgatgaggatcacgctcattggacagaagcaaaaatgctccttgacaatataaacacaccagaagggatcattccagccctctttgagccagagagagaaaagagtgcagcaatagatggggagtacagactgcggggagaagcaaggaaaacgttcgtggagctcatgagaagaggagatctaccagtttggctatcctacaaagttgcctcagaaggtttccagtactccgacagaaggtggtgctttgacggggaaaggaacaaccaggtgttggaggagaacatggacgtggagatctggacaaaggaaggagaaaggaagaaattgcgaccccgctggttggatgccagaacatactctgatccactggcccttcgtgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgctatggaggaactaccagacaccatagaaacattgatgctcctagctttgatagctgtgctgactggtggagtgacgctgttcttcctatcaggaaaaggtctagggaaaacatccattggcctgctctgtgtgatggcctcaagcgcactgttatggatggccaatgtggagccacattggatagcggcctccatcatactagagttctttctgatggtgctgctcattccagagccagacagacagcgcactccacaggacaaccagctagcatacgtggtgataggtttgttattcatgatactaacagtggcagccaatgagatgggattattggaaaccacaaagaaagacctggggattggccatgtagccgccgaaaaccaacaccatgccacgatgctggacgtagacctacgcccagcttcagcctggaccctctatgcagtagccacaacagttatcactcccatgatgagacacacaattgaaaacacaacagcaaacatttccctgacagccattgcaaaccaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagttaggccaaataatgttactgatactttgtacatcacagattctcttgatgcggaccacatgggccctgtgtgaatccatcacactggctactggacccttgaccactctctgggagggatctccaggaaaattctggaataccacgatagcagtgtccatggcaaacatcttcaggggaagttatctagcaggagcaggtctggccttctcgttaatgaaatctttgggaggaggcaggagaggtacgggggctcaaggagaaacactgggagagaaatggaaaagacagttaaaccaactgagcaagtcagaattcaacacctacaaaaggagtgggattatggaggtggacagatccgaagccaaagagggattaaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgccgggctgaagaaagtcactgaagtcaagggatacacaaaaggaggacctggacatgaggaacctgtcccaatggcgacctatggatggaacctagtaaagctatactctggaaaagatgtattttttacaccacctgagaaatgtgatacccttctgtgtgatataggagagtcctctccgaatccaactatagaagaaggaagaacgttacgtgttctaaagatggtagaaccatggctcagaggaaaccaattctgcataaaaattctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatgactcacaggaagccaacatatgaaagagacgtggacttaggcgctggaacaagacatgtggcagtggaaccagaggtagccaacctagatattattggccagaggatagagaatataaaaaatgaacacaagtcaacatggcattatgatgaagacaatccatacaaaacatgggcctatcatggatcatatgaggtcaaaccatcaggatcagcctcatctatggtgaatggcgtggtgagattgctcacaaaaccatgggatgtcatccccatggtcacacaaatagccatgaccgataccacacccttcggacaacagagagtgtttaaagagaaagtagatacgcgcacgccgagagcaaaacgaggcacagcacaaattatggaggtgacagccaagtggctatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggaacttcataaacagggaaaatgtgccacgtgcgtctacaacatgatggggaagagagagaaaaaattgggagagtttggaaaggcaaaaggaagtcgtgcaatatggtacatgtggctgggagcacgctttctagagttcgaagcccttggtttcatgaatgaagaccactggttcagtagagagaattcattcagtggagtggaaggagaaggactgcacaaacttggatacatactcagagacatatcaaagatcccggggggaaacatgtatgcagatgacacagccggatgggacacaagaataacagaggatgatcttcagaatgaggctaaaatcactgacatcatggagcctgaacacgctctattggctacgtcaatttttaagctgacctaccaaaacaaggtggtaagggtgcaaagaccagcaaaaaatggaaccgtgatggatgttatatccagacgagaccagagaggaagtgggcaggtcggaacctatggcttaaatactttcaccaatatggaggtccaactaataagacaaatggagtctgaaggaatctttttacccagcgaattggaaacccccaatctagctgagagagttcttgactggttggaaaaacatggcactgaaaggctgaaaagaatggcaattagcggagatgattgtgtggtgaaaccagtcgatgacaggtttgcaacagccttaatagctctgaatgacatgggaaaagtaagaaaagacataccgcagtgggaaccttcaaaaggatggaatgactggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctaagactagcggctaatgctatctgttcagctgtcccagttgactgggttccaaccagccgcacaacctggtcaatccatgctcaccatcaatggatgacaacagaagatatgttatcagtgtggaatagggtttggatagaggaaaacccatggatggaggataaaactcatgtatccagctgggaagaagtcccatacttagggaaaagggaagatcaatggtgtggatccctgataggcttgacagcgagggccacttgggccactaacatacaagtagccataaaccaagtgagaaggctcatcgggaatgagaattatctagattacatgacatcaatgaagagattcaagaatgagagtgatcccgaaggggcactctggtaa

SEQ ID NO: 5573 - RNA, 9879 nt, synthetic construct
  misc_feature 1..9879: note = derived and/or modified CDS sequence (wt) from DENV-1__FJ390380__SS-prME
  source 1..9879: mol_type = other RNA
tctgtgaccatgctcctcatgctgctgcccacagccctggcattccatttgaccacacgagggggagagccacacatgatagttagtaagcaggaaagaggaaagtcactgttgtttaagacctctgcaggcatcaatatgtgcactctcattgcgatggatttgggagagttatgtgaggacacaatgacctacaaatgcccccggatcactgaggcggaaccagatgacgttgactgctggtgcaatgccacagacacatgggtgacctatgggacatgttctcaaaccggcgaacaccgacgagacaaacgttccgtggcactggccccacacgtgggacttggtctagaaacaagaaccgaaacatggatgtcctctgaaggtgcctggaaacaaatacaaaaagtggagacttgggctttgagacacccaggattcacggtgacagccctttttttagcacatgccataggaacatccattactcagaaagggatcattttcattttgctgatgctagtaacaccatcaatggccatgcgatgtgtgggaataggcaacagggacttcgttgaaggactgtcaggagcaacgtgggtggacgtggtattggagcatggaagctgcgtcaccaccatggcaaaagataaaccaacattggacattgaactcttgaagacggaggtcacaaaccctgccgtcttgcgcaaactgtgcattgaagctaaaatatcaaacaccaccaccgattcaaggtgtccaacacaaggagaggccacactggtggaagaacaagactcgaactttgtgtgtcgacgaacgtttgtggacagaggctggggtaatggctgcggactatttggaaaaggaagcctactgacgtgtgctaagttcaagtgtgtgacaaaactagaaggaaagatagttcaatatgaaaacttaaaatattcagtgatagtcactgtccacactggggaccagcaccaggtgggaaacgagactacagaacatggaacaattgcaactataacacctcaagctcctacgtcggaaatacagctgactgactacggagccctcacattggactgctcacctagaacagggctggactttaatgagatggttctattgacaatgaaagaaaaatcatggcttgtccacaaacaatggtttctagacttaccactgccttggacttcaggagcttcaacatctcaagagacttggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacgatctttgcaggacacctgaaatgcagactaaaaatggataaactgactttaaaagggatgtcatatgtaatgtgcacaggctcatttaagctagagaaggaagtggctgagacccagcatggaactgttctagtgcaggttaaatacgaaggaacagatgcgccatgcaagatccctttttcggcccaagatgagaaaggagtgacccagaatgggagattgataacagccaaccccatagtcactgacaaagaaaaaccagtcaacattgagacagaaccaccttttggtgagagctacatcgtggtaggggcaggtgaaaaagctttgaaactgagctggttcaagaaagggagcagcatagggaaaatgttcgaagcaactgcccgaggagcacgaaggatggctatcctgggagacaccgcatgggactttggctctataggaggagtgttcacatcagtgggaaaattggtacaccaggtttttggagccgcatatggggttctgttcagcggtgtttcttggaccatgaaaataggaatagggattctgctgacatggttgggattaaattcaaggagcacgtcactttcgatgacgtgcattgcggttggcatggtcacactgtacctaggagtcatggttcaagcggactcgggatgtgtaatcaactggaaaggcagagaactcaaatgtggaagtggtatttttgtcaccaatgaagtccacacttggacagagcaatacaagttccaggctgactccccaaaaagactgtcagcagccattgggaaggcatgggaagagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccagggaaaaaaaatgattaggccacaacccatggaacatagatactcatggaaaagctggggaaaagccaaaatcataggagcagacatacagaatagcaccttcatcatcgacggcccagatactccagaatgccccgatgaccaaagagcgtggaacatttgggaagttgaagactatgggtttggaattttcacgacaaacatatggctgaaattgcgcgactcctacacccaaatgtgtgaccaccggctaatgtccgctgccatcaaagacagcaaggcagtccatgctgacatggggtactggatagaaagtgaaaagaacgagacctggaagctagcgagagcctccttcatagaagtcaagacatgtatctggccgaaatcccacactctatggagtaatggagttttggaaagtgaaatgataatcccaaagatatacggaggaccaatatctcagcacaactacagaccagggtatttcacacaaacagcaggaccatggcacctaggcaagttggaattggattttgagttgtgtgaaggtaccacagttgttgtggatgaacattgtggaaatcgaggcccatctctcagaactacaacagtcacaggaaagataatccatgaatggtgttgcagatcctgcacgttaccccccttacgcttcagaggagaagacggatgttggtatggcatggaaatcagaccagttaaggagaaggaggaaaacctagttaggtcaatggtctctgcagggtcaggagaagtggacagtttttcactagggatactatgcgtatcaataatgattgaagaagtgatgagatccagatggagtagaaagatgctgatgactggaacattggttgttttcttccttcttataatgggacaactgacatggaatgacctgattaggttatgcatcatggttggagctaatgcttcagacaggatggggatgggaacaacgtacctggccttgatggctactttcaaaatgagaccaatgttcgctgttgggctactatttcgcagactaacatccagagaagttcttcttctcacgattggattaagcctggtggcatccgtggagttaccaaattctttggaggagctaggggatggacttgcaatgggtatcatgatgttaaaattattgactgaatttcagccacaccagttatggaccaccttactgtctctgacatttatcaaaacaactctttcattggattatgcatggaggacaatggctatggtgctgtcaatcgtatctctctttcctttatgtctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactccttaaaaatgatgtgccgttggccggcccactgatagctggaggcatgctaatagcatgttatgtcatatccggaagctcagccgatttatcattggagaaagcggctgaggtatcctgggaagaagaagcagaacactctggtacctcacacaacatattagtagaggtccaagatgatggaactatgaaaataaaggatgaagagagggatgacacactcaccatactcctcaaagcaactttgctggcagtctcaggagtgtacccaatgtcaataccagcaacttttttcgtgtggtatttttggcagaaaaagaaacagagatcaggagtgttatgggacacacccagccctccggaagtggaaagagcagttcttgatgatggcatctatagaatcctgcaaagaggactgttgggcaggtcccaagtaggagtgggagttttccaggacggcgtgttccacacaatgtggcacgtcaccaggggagctgtccttatgtaccaagggaagaggttagaaccaagctgggccagtgtcaaaaaggacttgatctcatatggaggaggttggagatttcaaggatcatggaacacgggagaagaggtgcaggtgatagccgttgaaccaggaaaaaatcctaaaaatgtacagacaacgccgggtaccttcaagactcccgaaggcgaagttggagccatagctctagattttaaacccggcacatctggatctcccatcgtgaacagagagggaaaaatagtaggtctttatggaaatggagtggtaacaacaagtggaacctacgtcagtgccattgcccaagctaaaacatcacaagaagggcctctaccagagattgaggaggaggtgtttaagaaaaggaacttaacaataatggacctgcacccaggatcgggaaaaacaagaagatatcttccagccatagtccgtgaggccataaaaaggaaactgcgcacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatctccagtgagagttcccaattacaacatgattatcatggatgaagcacattttaccgatccagccagcatagcggccagagggtacatctcaactcgagtgggtatgggtgaagcagctgcgatctttatgacagccactcccccaggatcggtggaggcctttccacaaagtaatgcagttatccaagatgaggaaagagacattcctgagagatcatggaactcaggctacgactggatcactgattttccaggtaaaacagtctggtttgttccaagcattaagtcaggaaatgacattgctaactgtttaagaaagaacggaaaacgggtgatccaattgagcagaaaaacctttgacactgagtaccagaaaacaagaaacaatgactgggactatgttgtcacaacagacatttccgaaatgggggcaaatttccgggccgacagggtaatagacccaaggcggtgcttgaaaccagtgatactaaaagatggtccagagcgtgtcattctagccggaccaatgccagtgactgtggccagtgctgcccagagaagaggaagaattggaaggaaccaaaacaaggaaggtgatcagtacgtttatatgggacagcctttaaataatgatgaggatcacgctcattggacagaagcaaaaatgctccttgataatataaacacaccagaagggatcattccagccctctttgagccagagagagaaaagagtgcagcaatagatggggagtacagactgcggggagaagcaaggaaaacgttcgtggagctcatgagaagaggagatctaccagtttggctatcctacaaagttgcttcagaaggtttccagtactccgacagaaggtggtgctttgacggggaaaggaacaaccaggtgttggaggagaacatggacgtggagatctggacaaaggaaggagaaaggaagaaattgcgaccccgctggttggatgccagaacatactctgatccactggcccttcgtgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgctatggaggaactaccagacaccatagaaacattgatgctcctagctttgatagctgtgctgactggtggagtgacgctgttcttcctatcaggaaaaggtctagggaaaacatccattggcctgctctgtgtgatggcctcaagcgcactgttatggatggccaatgtggagccacattggatagcggcctccatcatactagagttctttctgatggtgctgctcattccagagccagacagacagcgcactccacaggataaccagctagcatacgtggtgataggtttgttattcatgatactgacagtggcagccaatgagatgggattattggaaaccacaaagaaagacctggggattggccatgtagccgccgaaaaccaacaccatgccacgatgctggacgtagacctacgcccagcttcagcctggaccctctatgcagtagccacaacagttatcactcccatgatgagacacacaattgaaaacacaacagcaaacatttccctgacagccattgcaaaccaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagttaggtcaaataatgttactgatactttgtacatcacagattctcttgatgcggaccacatgggccctgtgtgaatccatcacactggctactggacccttgaccactctctgggagggatctccaggaaaattctggaataccacgatagcagtgtccatggcaaacatcttcaggggaagttatctagcaggagcaggtctggccttctcgttaatgaaatctttgggaggaggcaggagaggtacgggggctcaaggagaaacactgggagagaaatggaaaagacagttaaaccaactgagcaagtcagaattcaacacctacaaaaggagtgggattatggaggtggacagatccgaagccaaagagggattaaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtcaagggatacacaaaaggaggacctggacatgaggaacctatcccaatggcgacctatggatggaacctagtaaagctatactctggaaaagatgtattttttacaccacctgagaaatgtgatacccttctgtgtgatataggagagtcctctccgaatccaactatagaagaaggaagaacgttacgtgttctaaagatggtagaaccatggctcagaggaaaccaattctgcataaaaattctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatgactcacaggaagccaacatatgaaagagacgtggacttaggcgctggaacaagacatgtggcagtggaaccagaggtagccaacctagatattattggccagaggatagagaatataaaaaatgaacacaagtcaacatggcattatgatgaagacaatccatacaaaacatgggcctatcatggatcatatgaggtcaaaccatcaggatcagcctcatctatggtgaatggcgtggtgagattgctcacaaaaccatgggatgtcatccccatggtcacacaaatagccatgaccgataccacacccttcggacaacagagagtgtttaaagagaaagtagatacgcgcacgccgagagcaaaacgaggcacagcacaaattatggaggtgacagccaagtggctatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggaacttcataaacagggaaaatgtgccacgtgtgtctacaacatgatggggaagagagagaaaaaattgggagagtttggaaaggcaaaaggaagtcgtgcaatatggtacatgtggctgggagcacgctttctagagttcgaagcccttggtttcatgaatgaagatcactggttcagtagagagaattcattcagtggagtggaaggagaaggactgcacaaacttggatacatactcagagacatatcaaagatcccggggggaaacatgtatgcagatgacacagccggatgggacacaagaataacagaggatgatcttcagaatgaggccaaaatcactgacatcatggagcctgaacacgctctattagctacgtcaatttttaagctgacctaccaaaacaaggtggtaagggtgcaaagaccagcaaaaaatggaaccgtgatggatgttatatccagacgagaccagagaggaagtgggcaggtcggaacctatggcttaaatactttcaccaatatggaggtccaactaataagacaaatggagtctgaaggaatctttttacccagcgaattggaaacccccaatctagctgagagagttcttaactggttggaaaaacatggcactgaaaggctgaaaagaatggcaattagcggagatgattgtgtggtgaaaccagttgatgacaggtttgcaacagccttaatagctctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctaagactagcggctaatgctatctgttcagctgtcccagttgattgggttccaaccagccgcacaacctggtcaatccatgctcaccatcaatggatgacaacagaagatatgttatcagtgtggaatagggtttggatagaggaaaacccatggatggaggataaaactcatgtatccagctgggaagaagtcccatacttagggaaaagggaagatcaatggtgtggatccttgataggcttgacagcgagggccacttgggccactaacatacaagtagccataaaccaagtgagaaggctcatcggaaatgagaattatctagattacatgacatcaatgaagagattcaagaatgagagtgatcccgaaggggcactctggtaa

SEQ ID NO: 5574 - RNA, 9879 nt, synthetic construct
  misc_feature 1..9879: note = derived and/or modified CDS sequence (wt) from DENV-1__FJ205874__SS-prME
  source 1..9879: mol_type = other RNA
tccgtgaccatgctcctcatgctgctgcccacagtcctggctttccatttgaccacacgagggggagagccacacatgatagttggtaagcaggaaagaggaaagtcactcttgttcaagacctctgcaggtgtcaatatgtgcactctcatcgcgatggatttgggagagttgtgtgaggacacaatgacttacaaatgcccccggatcactgaggcggaaccagatgacgttgactgctggtgcaatgccacagacacatgggtgacctatgggacgtgttctcaaaccggtgaacaccgacgagacaaacgttccgtggcactggccccacacgtgggacttggtctagaaacaagaactgaaacatggatgtcctcagaaggcgcctggaaacaaatacaaaaagtggagacttgggctttgagacatccaggattcacggtgatagctttttttttagcacatgccataggaacatccatcactcagaaagggatcattttcattctgctgatgctggtaacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaattgtgcattgaagctaaaatatcaaacaccaccaccgattcaagatgtccaacacaaggagaggctacactagtggaagaacaagacgcgaactttgtgtgtcgacgaacgtttgtggacagaggctggggcaatggctgcggactatttggaaaaggaagcctactgacgtgtgctaagttcaagtgtgtgacaaaactggaaggaaagatagttcaatatgaaaacttaaaatattcagtgatagtcactgtccacacaggggaccagcaccaggtgggaaacgagactacagaacatggaacaattgcaaccataacacctcaagctcctacgtcggaaatacagctgaccgactacggagccctcacactggactgctcacccagaacagggctggactttaatgagatggtgctattgacaatgaaagaaaaatcatggcttgtccacaaacaatggtttctagacttaccactgccttggacttcgggagcttcaacatctcaagagacttggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacacctgaaatgcagactaaaaatggataaactgactttaaaagggatgtcatatgtgatgtgcacaggctcatttaagctagagaaggaagtggctgagacccagcatgggactgttctagtgcaggttaaatacgaaggaacagatgcgccatgtaagatccccctttcgacccaagatgagaaaggagtgacccagaatgggagattgataacagccaatcccatagttactgacaaagaaaaaccagtcaacattgagacagaaccaccttttggtgagagctacatcatagtaggggcaggtgaaaaagctttgaaactaagctggttcaagaaaggaagcagcatagggaaaatgttcgaagcaaccgcccgaggagcacgaaggatggctatcctgggagacaccgcatgggacttcggctctataggaggagtgttcacgtctgtgggaaaattggtacaccaggtttttggaaccgcatacggggtcctgttcagcggcgtttcttggaccatgaaaataggaatagggatcctgctgacatggttgggattaaattcaaggagcgcgtcgctttcgatgacgtgcattgcagttggcatggttacactgtacctaggagtcatggttcaagcggactcgggatgtgtaatcaactggaagggcagagaactcaagtgtggaagtggcatttttgtcactaatgaagtccacacttggacagagcaatacaaattccaagctgactccccaaaaagactgtcagcagccattgggaaggcatgggaggagggcgtgtgtggagttcgatcagccacgcgtcttgagaatatcatgtggaagcaaatatcaaatgaattgaaccacattctactcgaaaatgacatgaaattcacagtggttgtaggagatgctaatggaattttggcccaggggaaaaaaatgatcaggccacaacccatggaacacaaatactcatggaaaagctggggaaaagccaagatcataggagcagacatacagaataccaccttcatcatcgacggcccagacactccagaatgccccgatgaccaaagagcgtggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacctggaggttagcgagagcctccttcatagaagtcaagacatgcatttggccgaaatcccacactctatggagtaatggagttttggaaagtgaaatgataatcccaaagatatatggaggaccaatatctcagcacaattacagaccagggtatttcacacaaacagcagggccatggcatctaggcaagttggaattggattttgacttgtgtgaaggcaccacagttgttgtggatgaacattgtggaaatcgaggtccatctctcagaactacaacagtcacaggaaagataatccatgaatggtgttgcagatcctgcacgttaccccccttacgcttcagaggagaagacggatgttggtatggcatggaaatcagaccagttaaggagaaggaggagaacctagttaggtcaatggtctctgcagggtcaggagaagtggacagtttttcattgggaatattatgcttatcaataatgattgaagaagtgatgagatccagatggagtagaaagatgctgatgactggaacactggctgttttcctccttcttataatgggacaactgacatggaatgatctgattaggttatgcatcatggttggagctaatgcttctgacaggatggggatgggaacaacgtacctagccttgatggctactttcaaaatgagaccaatgttcgccgttgggttattatttcgcagactaacatccagagaggttcttcttctcacgattggattaagcctggtggcatccgtggagctaccaaattctttggaggagctaggggatggacttgcaatgggcatcatgatgttaaaactattgaccgaatttcagccacaccagttatggaccaccttactgtctctgacatttatcaaaacaactctttcattggattatgcatggaagacaatggctatggtactgtcaatcgtatctctctttcctttatgtctgtctacgacctcccaaaagacaacatggcttccggtgctgttaggatcttttggatgcaaaccattaaccatgtttctcataacagaaaacaaaatctggggaaggaaaagttggcccctcaatgaaggaattatggccattggaatagtcagcattctgctaagttcactcctcaaaaatgatgtgccgttggccggcccactaatagctggaggcatgctaatagcatgttatgtcatatccggaagctcagccgatctatcattggagaaagcggctgaggtatcctgggaagaagaagcagaacactccggtacctcacacaacatattagtagaggtccaagatgatggaactatgaaaataaaagatgaagagagggatgacacactcaccatcctcctcaaagcaactctgctggcagtttcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactattgggcaggtcccaagtgggagtgggagttttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaaaaatgtacagacaacgccgggtaccttcaagactcccgaaggtgaagttggagccgtagctctagattttaaacccggcacatctggatctcccattgtgaacagagagggaaaaatagtaggtctttatggaaatggagtggtgacaacaagtggaacctacgtcagtgctattgcccaagctaaagcatcacaagaagggcccctaccagagattgaggacgaggtgtttaagaaaagaaacttaacaataatggacctgcatccaggatcaggaaaaacaagaagatatcttccagccatagtccgtgaggccataaaaaggaaactgcgcacgttaatcttggctcccacaagagttgtcgcctctgaaatggcagaagcgctcaagggaatgccaataagatatcagacaacagcagtgaagagtgagcacacaggaagggagatagttgatctcatgtgccacgccacttttaccatgcgtctcttatctccagtgagagttcccaattacaacatgattatcatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaagaaagagacattcctgagagatcatggagctcaggctacgattggatcactgattttccaggtaaaacagtctggtttgttccaagcattaaatcaggaaatgacattgccaactgtttaagaaagaacggaaaacgggtgatccaattgagcagaaaaacctttgacaccgagtaccagaaaacaaaaaacaatgactgggactatgttgtcacaacagacatttccgaaatgggagcaaatttcagggccgacagggtaatagacccaaggcggtgcttgaaaccggtaatactaaaagatggtccagagcgcgtcattttagctggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaacataaacacaccagaagggatcatcccagccctctttgagccagagagagaaaagagcgcagcaatagacggggagtacagactgcggggagaagcaaggaaaacgttcgtggagctcatgaaaagaggagatctaccagtttggctatcctacaaagttgcctcagaaggttttcagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccactggccctgcgcgagttcaaagagtttgcagcaggaagaagaagtgtctcaggtgacctaatcttggaaatagggaaacttccacaacatttgacgctaagagcccagaatgctctggataacttggtcatgttgcacaattccgaacaaggaggaaaagcctatagacatgctatggaggaactaccagacaccatagaaacattgatgctcctagctttgatagctgtgctgactggtggagtgatgctgttcttcctatcaggaaaaggtctagggaaaacatccatcggcctgctctgtgtgatggcctcaagcgcactgttatggatggccagtgtggagccccattggatagcggcctccatcatactagagttctttctaatggtgctgctcattccagagccagacagacagcgcactccacaggacaaccagctagcgtatgtagtgataggtttgttattcatgatactgacagtggcagccaatgagatgggattattggaaaccacaaagaaagacctggggattggccatgtagccgccgaaaaccaccaccacgttacaatgctggacgtagacctacgtccagcttcagcctggaccctctatgcggtagccacaacagttatcactcccatgatgagacacacaattgaaaatacaacagcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgctgatgttagtggctcattatgccataattggaccaggactgcaagcaaaggccactagagaagctcaaaaaaggacagcggccggaataatgaaaaatccaaccgtagatgggattgttgcaatagacttggatcctgtggtttatgatgcaaaatttgaaaaacaactaggccaaataatgttactgatactttgtacatcacagattctcttgatgcggaccacatgggccttgtgtgagtccatcacactggctactggacccttgaccactctctgggagggatctccaggaaaattctggaataccacgatagcagtgtccatggcaaacatcttcaggggaagttatctagcaggagcaggtctggccttctcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatctgaagccaaagagggattgaaaagaggagaaacaaccaaacatgcagtgtcgagaggaacagccaaactgaggtggtttgtggagaggaaccttgtgaaaccagaagggaaagtcatagatctcggttgtggaagaggtggctggtcatattattgtgctgggctgaagaaagtcactgaagtgaagggatacacaaaaggaggacctgggcatgaggaacctatcccaatggcgacttatggatggaacctagtaaagctacactctggaaaagatgtattttttacaccacctgagaaatgtgatacccttctgtgtgatattggtgagtcctctccgaatccaactatagaagaaggaagaacgttacgtgttctaaagatggtggaaccatggcttagaggaaaccaattttgcataaaaatcctaaatccttatatgccaagtgtggtagaaactctggagcaaatgcaaaggagacatggagggatgctagtgagaaacccactctcaagaaattccacccatgaaatgtactgggtttcatgtggaacaggaaacattgtgtcggcagtgaacatgacatccagaatgttactgaatcgattcacaatggcgcataggaagccaacatatgaaagagacgtggacttaggcgctggaacaagacatgtggcagtggaaccagaggtagccaacctaggtatcattggccagagaatagagaatataaaaaatgaacacaagtcaacatggcattatgatgaagacaatccatacaaaacatgggcctatcatggatcatatgaggtcaagccatcaggatcagcctcatctatggtgaatggcgtggtgagattgctcacaaaaccatgggatgttatccccatggtcacacaaatagctatgactgataccacacccttcggacaacagagagtgtttaaagagaaagttgatacgcgcacaccaagagcaaaacgaggcacagcacaaattatggaggtgacagccaaatggttatgggatttcctttccagaaacaaaaaacccagaatctgcacaagagaggagttcataagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgcgccacgtgtgtctacaacatgatggggaagagagagaaaaaattaggagagtttggaaaggcaaaaggaagtcgtgcaatatggtacatgtggctgggagcacgctttctagagttcgaagcccttggtttcatgaatgaagatcactggttcagtagagagaattcactcagtggagtggaaggagaaggactgcacaaacttggatacatactcagagacatatcaaagattccggggggaaacatgtatgcagatgatacagccggatgggacacaagaataacagaggatgatcttcagaatgaggctaaaatcactgacatcatggagcctgaacatgctctattggctacgtcaatttttaagctaacctaccaaaacaaggtggtgagggtgcaaagaccagcaaaaaatggaaccgtgatggatgttatatccagacgtgaccagagaggaagtggacaggtcggaacttatggcttaaatactttcaccaatatggaggtccaactaataagacaaatggagtctgaaggaatctttttacccagcgaactagaaaccactaatctagctgagagagttcttgactggttggaaaaacatggtgtcgaaaggctgaaaagaatggcaattagtggagatgattgtgtggtgaaaccaattgatgacaggttcgcaacagccttaatagctctgaatgacatgggaaaagtaagaaaagacataccgcagtgggaaccctcaaaaggatggaatgactggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatacgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtctggatagaggaaaacccatggatggaggacaaaactcatgtatccagttgggaagaagttccatacctagggaaaagggaagatcaatggtgtggatctctgataggcttgacagcgagggccacctgggccaccaacatacaagtagccataaaccaagtgagaaggctcattgggaatgagaattatctagattacatgacatcaatgaagagattcaagaatgagagtgatcccgaaggggcactctggtaa

SEQ ID NO: 5575 - RNA, 9879 nt, synthetic construct
  misc_feature 1..9879: note = derived and/or modified CDS sequence (wt) from DENV-1__FJ205875__SS-prME
  source 1..9879: mol_type = other RNA
tctgtgaccatgctcctcatgctgctgcccacagccctggcgttccatttgaccacacgagggggagagccacacatgatagttagcaagcaggaaagaggaaagtcactgttgtttaagacctctgcaggcatcaatatgtgcactctcattgcgatggatttgggagagttatgcgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggacttggtctagaaacaagaaccgaaacatggatgtcctctgaaggtgcctggaaacaaatacaaaaagtggagacttgggctttgagacacccaggattcacggtgatagccctttttttagcacatgccataggaacatccattactcagaaagggatcattttcattttgttgatgctagtaacaccatcaatggccatgcgatgtgtaggaataggcaacagagacttcgttgaaggactgtcaggagcaacgtgggtggacgtggtattggagcatggaagctgcgtcaccaccatggcaaaagataaaccaacattggacattgaactcttgaagacggaggtcacgaaccctgccatcttgcgcaaactgtgcattgaagctaaaatatcaaacaccaccaccgattcaaggtgtccaacacaaggagaggctacactggtggaagaacaagacgcgaactttgtgtgtcgacgaacgtttgtggacagaggctggggtaatggctgcggactatttggaaaaggaagcctactgacgtgtgctaagttcaagtgtgtgacaaaactagaaggaaagatagttcagtatgaaaacttaaaatattcagtgatagtcactgtccacactggggaccagcaccaggtgggaaacgagactacagaacatggaacaattgcaactataacacctcaagctcctacgtcggaaatacagctgactgactacggagccctcacattggactgctcacctagaacagggttggacttcaatgagatggtgctattgacaatgaaagaaaaatcatggcttgtccacaaacaatggtttctagacttaccactgccttggacttcgggagcttcaacatctcaagagacctggaacagacaagatttgctggtcacattcaagacagctcatgcaaagaaacaggaagtagtcgtactgggatcacaggaaggagcaatgcacactgcgttgactggggcgacagaaattcagacgtcaggaacgacaacaatctttgcaggacacctgaaatgcagactaaaaatggataaactgactttaaaagggatgtcatatgtaatgtgcacaggctcatttaagctagagaaggaagtggctgagacccagcatggaactgttctagtgcaggttaaatacgaaggaacagatgcgccatgcaagatccctttttcgacccaagatgagaaaggagtgacccagaatgggagattgataacagccaaccccatagtcactgacaaagaaaaaccagttaacattgagacagaaccaccttttggtgagagctacatcgtggtaggggcaggtgaaaaagctttgaaactgagctggttcaagaaagggagcagcatagggaaaatgttcgaagcaaccgcccgaggagcacgaaggatggctatcctgggagacaccgcatgggactttggctctataggaggagtgttcacgtcagtgggaaaattggtacaccaggtttttggaaccgcatatggggttctgttcagcggtgtttcttggaccatgaaaataggaatagggattctgctgacatggttgggattaaattcaaggagcacgtcactttcgatgacgtgcattgcggttggcatggtcacactgtacctaggagtcatggttcaagcggactcgggatgtgtaatcaactggaagggcagagaactcaaatgtggaagtggtatttttgtcactaatgaagtccacacttggacagagcaatacaaattccaggctgactccccaaaaagactgtcagcagccattgggaaggcatgggaggagggcgtgtgtggaattcgatcagccacgcgtcttgagaacatcatgtggaagcaaatatcaaatgagttgaaccacattctacttgaaaatgacatgaaattcacagtggttgtaggagatgctaatggaattttggcccaagggaaaaaaatgattaggccacaacccatggaacacaaatactcatggaaaagctggggaaaagccaaaatcataggagcagacatacagaataccaccttcatcatcgacggcccagacactccagaatgccccgatgaccaaagagcgtggaacatttgggaagttgaggactatgggtttggaattttcacgacaaacatatggctgaaattgcgcgactcctacacccaaatgtgtgaccaccggctaatgtcagctgccatcaaggacagcaaggcagtccatgctgacatgggatactggatagaaagtgaaaagaacgagacctggaagctagcgagagcctccttcatagaagtcaagacatgcatctggccgaaatcccacactctatggagtaatggagttttggaaagtgaaatgataatcccaaagatatatggaggaccaatatctcagcacaactacagaccagggtatttcacacaaacagcagggccatggcacctaggcaagttggaattggattttgacttgtgtgaaggtaccacagttgttgtggatgaacattgtggaaatcgaggtccatctctcagaactacaacagtcacaggaaagataatccatgaatggtgttgcagatcctgcacgttaccccccttacgcttcagaggagaagacggatgttggtatggcatggaaattagaccagttaaggagaaggaggaaaacctagttaggtcaatggtctctgcagggtcaggagaagtggacagtttttcactagggatactatgcgtatcaataatgattgaagaagtgatgagatccagatggagtaaaaagatgctgatgactggaacactggctgttttcctccttcttataatgggacaactgacatggaatgatctgattaggttatgcatcatggttggagctaatgcttcagacaggatggggatgggaacaacgtaccttgccttgatggctactttcaaaatgagaccaatgttcgctgttgggctattatttcgcagactaacatccagagaagttcttcttctcacgattggattaagcctggtggcatccgtggagttaccaaattctttggaggagctaggggatggacttgcaatgggtatcatgatgttaaaattattgactgaatttcagccacaccagttgtggaccaccttactgtctttgacatttatcaaaacaactctttcattggattatgcatggaggacaatggctatggtgctgtcaatcgtatctctctttcctttgtgtctgtccacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactccttaaaaatgatgtgccgttagccggcccactaatagctggaggtatgctaatagcatgttatgtcatatccggaagctcagccgatttatcattggagaaagcggctgaggtatcctgggaagaagaagcagaacactctggtacctcacacaacatattagtagaggtccaagatgatggaactatgaaaataaaagatgaagagagggatgacacacttaccatactcctcaaagcaactctgctggcagtttcaggagtgtacccaatgtcaataccagcaactcttttcgtgtggtatttttggcagaaaaagaaacagagatcaggagtgttatgggacacacccagccctccggaagtggaaagagcagttcttgatgatggcatctatagaatcctgcaaagaggactgttgggcaggtcccaagtgggagtgggagtttttcaagacggcgtgttccacacaatgtggcacgtcaccaggggagctgtccttatgtaccaagggaagaggttggaaccaagctgggccagtgtcaaaaaggacttgatctcatatggaggaggttggaggttccaaggatcatggagcacgggagaagaagtgcaggtgatagctgttgaaccaggaaaaaatcccaaaaatgtacagacaacgccgggtaccttcaagactcccgaaggcgaagttggagccatagctctagattttaaacccggcacatctggatctcccatcgtgaacagagaggggaaaatagtaggtctttatggaaatggagtggtgacaacaagtggaacctacgtcagtgccattgcccaagctaaaacatcacaagaagggcctctaccagagattgaggacgaggtgtttaagaaaaggaacttaacaataatggacctgcatccaggatcaggaaaaacaagaagatatctaccagccatagtccgtgaggccataaaaaggaaactgcgcacattaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatctccagtgagagttcccaattacaacatgattatcatggatgaagcacattttaccgatccagccagcatagcggccagagggtacatctcaacccgagtgggtatgggtgaagcagctgcgatctttatgacagccactcccccaggatcggtggaggcctttccacaaagcaatgcagttatccaagatgaggaaagagacattcctgagagatcatggaactcaggctacgactggatcactgattttccaggtaaaacagtctggtttgttccaagcattaaatcaggaaatgacattgctaactgtttgagaaagaacggaaaacgggtgatccaattgagcagaaaaacctttgacactgagtaccagaaaacaaaaaacaatgactgggactatgttgtcacaacagacatttccgaaatgggggcaaatttccgggccgacagggtaatagacccaaggcgatgcttgaaaccagtgatactaaaagatggtccagagcgtgtcattctagccggaccgatgccagtgactgtggccagtgctgcccagagaagaggaagaattggaaggaaccaaaacaaggaaggtgatcagtacgtttacatgggacagcctttaaataatgatgaggatcacgctcattggacagaagcaaaaatgctccttgacaatataaacacaccagaagggatcattccagccctctttgagccagagagagaaaagagtgcagcaatagatggggagtacagactgcggggagaagcaaggaaaacgttcgtggagctcatgagaagaggagatctaccagtttggctatcctacaaagttgcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccactggcccttcgtgagttcaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgctatggaagaactaccagacaccatagaaacattgatgctcctagctctgatagctgtgctgactggtggagtgacgctgttcttcctatcaggaaaaggtctagggaaaacatccattggcctgctctgtgtgatggcctcaagcgcactgttatggatggccaatgtggagccacattggatagcggcctccatcatactagagttctttctgatggtgctgctcattccagagccagacagacagcgcactccacaggacaaccagctagcatacgtggtgataggtttgttattcatgatactgacagtggcagccaatgagatgggactattggaaaccacaaagaaagacctggggattggccatgtagccgccgaaaaccaccaccatgccacgatgctggacgtagacctacgcccagcttcagcctggaccctctatgcagtagccacaacagtcatcactcccatgatgagacacacaattgaaaatacaacggcaaacatttccctgacagccattgcaaaccaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtctatgatgcaaagtttgaaaaacagctaggccaaataatgttactgatactttgtacatcacagattctcttgatgcggaccacatgggccttgtgtgaatccatcacactggccactggacccttgaccactctctgggagggatctccaggaaaattctggaataccacgatagcagtgtccatggcaaacatcttcaggggaagttatctagcaggagctggtctggccttctcgttaatgaaatctctaggaggaggcaggagaggtacgggggctcaaggagaaacactgggagagaaatggaaaagacagttaaaccaactgagcaagtcagaatttaacacctacaaaaggagtgggattatggaggtggacagatccgaagccaaagagggattaaaaagaggagaaacaaccaaacatgcagtgtcgagaggtacagccaaactgaggtggcttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaaactatactctggaaaagatgtattttttacaccacctgagaaatgtgatacccttttgtgtgatattggagagtcctctccgaatccaactatagaagaaggaagaacgttacgtgttttaaagatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaatatgacatccagaatgttactgaatcgattcacaatggttcacaggaagccaacatatgaaagagacgtggacttaggcgctggaacaagacacgtggcagtggaaccagaggtagccaacctagatatcattggccagaggatagagaatataaaaaatgaacacaagtcaacatggcattatgatgaagacaatccatacaaaacatgggcctatcatggatcatatgaggtcaaaccatcaggatcagcctcatctatggtgaatggcgtggtgagactgctcacaaaaccatgggatgtcatccccatggtcacacaaatagccatgactgataccacacccttcggacaacagagagtgtttaaagagaaagttgacacgcgcacaccaagagcaaaacgaggcacagcacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctagagttcgaagcccttggtttcatgaatgaagatcactggttcagtagagagaattcattcagtggagtggagggagacggactgcacaaacttggatacatactccgagacatatcaaagattccggggggaaatatgtatgcagatgacacagccggatgggacacaagaataacagaggatgatcttcagaatgaggctaaaatcactgacatcatggagcctgaacacgccctattggctacgtcaatttttaagctgacctaccaaaacaaggtggtaagggtgcaaagaccagcaaaaaatggaaccgtgatggatgttatatccagacgagaccagagaggaagtgggcaggtcggaacctacggcttaaatactttcacaaatatggaggcccaactaataagacaaatggagtctgaaggaatctttctacccagcgaattggaaacccccaatctagctgagagagttcttgactggttggaaaaacatggcaccgaaaggctgaaaagaatggcaattagcggagatgattgtgtggtgaaaccagttgatgataggtttgcaacagccttaacagctctgaatgacatgggaaaagtaagaaaagacataccgcagtgggaaccttcaaaaggatggaatgactggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaatgctatctgttcagctgtcccagttgactgggtcccaaccagccgcacaacctggtcaatccatgctcaccatcaatggatgacaacagaagacatgctatcagtgtggaatagggtttggatagaggaaaacccatggatggaggacaaaactcatgtatccagctgggaagaagttccatacttagggaaaagagaagatcaatggtgtggatccctgataggcttgacagcaagggccacttgggccactaacatacaagtggccataaaccaggtgagaaggctcatcgggaatgagaattatctagattacatgacatcaatgaagaggtttaagaacgagagtgatcccgaaggggcactctggtaa

SEQ ID NO: 5576 - RNA, 9879 nt, synthetic construct
  misc_feature 1..9879: note = derived and/or modified CDS sequence (wt) from DENV-1__FJ410173__SS-prME
  source 1..9879: mol_type = other RNA
tctgtgaccatgctcctcatgctgttgcccacagccctggcgttccatttgaccacacgagggggagagccacacatgatagttagtaagcaggaaagaggaaagtcactgttgtttaagacctctgcaggcatcaatatgtgcactctcattgcgatggatttgggagagttatgtgaggacacaatgacctacaaatgcccccggatcactgaggcggaaccagatgacgttgactgctggtgcaatgccacagacacatgggtgacctatgggacatgttctcaaaccggcgaacaccgacgagacaaacgttccgtggcactggccccacacgtgggacttggtctagaaacaagaaccgaaacatggatgtcctctgaaggtgcctggaaacaaatacaaaaagtggagacttgggctttgagacacccaggattcacggtgacagccctttttttagcacatgccataggaacatccattactcagaaagggatcattttcattttgctgatgctagtaacaccatcaatggccatgcgatgtgtaggaataggcaacagggacttcgttgaaggactgtcaggagcaacgtgggtggacgtggtattggagcatggaagctgcgtcaccaccatggcaaaagataaaccaacattggacattgaactcttgaagacggaggtcacaaaccctgccgtcttgcgcaaactgtgcattgaagctaaaatatcaaacaccaccaccgattcaaggtgtccaacacaaggagaggccacactggtggaagaacaagactcgaactttgtgtgtcgacgaacgtttgtggacagaggctggggtaatggctgcggactatttggaaaaggaagcctactgacgtgtgctaagttcaagtgtgtgacaaaactagaaggaaagatagttcaatatgaaaacttaaaatattcagtgatagtcactgtccacactggggaccagcaccaggtgggaaacgagactacagaacatggaacaattgcaactataacacctcaagctcctacgacggaaatacagctgactgactacggagccctcacattggactgctcacctagaacagggctggactttaatgagatggttctattgacaatgaaagaaaaatcatggcttgtccacaaacaatggtttctagacttaccactgccttggacttcaggagcttcaacatctcaagagacttggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacgatctttgcaggacacctgaaatgcagactaaaaatggataaactgactttaaaagggatgtcatatgtaatgtgcacaggctcatttaagctagagaaggaagtggctgagacccagcatggaactgttctagtgcaggttaaatacgaaggaacagatgcgccatgcaagatccctttttcggcccaagatgagaaaggagtgacccagaatgggagattgataacagccaaccccatagtcactgacaaagaaaaaccagtcaacattgagacagaaccaccttttggtgagagctacatcgtggtaggggcaggtgaaaaagctttgaaactgagctggttcaagaaagggagcagcatagggaaaatgttcgaagcaactgcccggggagcacgaaggatggctatcctgggagacaccgcatgggactttggctctataggaggagtgttcacatcagtgggaaaattggtacaccaggtttttggagccgcatatggggttctgttcagcggtgtttcttggaccatgaaaataggaatagggattctgctgacatggttgggattaaattcaaggagcacgtcactttcgatgacgtgcattgcggttggcatggtcacactgtacctaggagtcatggttcaagcggactcgggatgtgtaatcaactggaaaggcagagaactcaaatgtggaagtggtatttttgtcaccaatgaagtccacacttggacagagcaatacaagttccaggctgactccccaaaaagactgtcagcagccattgggaaggcatgggaagagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaggggaaaaaaatgattaggccacaacccatggaacatagatactcatggaaaagctggggaaaagccaaaatcataggagcagacatacagaatagcaccttcatcatcgacggcccagatactccagaatgccccgatgaccaaagagcgtggaacatttgggaagttgaagactatgggtttggaattttcacgacaaacatatggctgaaattgcgcgactcctacacccaaatgtgtgaccaccggctaatgtccgctgccatcaaagacagcaaggcagtccatgctgacatggggtactggatagaaagtgaaaagaacgagacctggaagctagcgagagcctccttcatagaagtcaagacatgtatctggccgaaatcccacactctatggagtaatggagttttggaaagtgaaatgataatcccaaagatatatggaggaccaatatctcagcacaactacagaccagggtatttcacacaaacagcaggaccatggcacctaggcaagttggaattggattttgacttgtgtgaaggtaccacagttgttgtggatgaacattgtggaaatcgaggcccatctctcagaactacaacagtcacaggaaagataatccatgaatggtgttgcagatcctgcacgttaccccccttacgcttcagaggagaagacggatgttggtatggcatggaaatcagaccagttaaggagaaggaggaaaacctagttaggtcaatggtctctgcagggtcaggagaagtggacagtttttcactagggatactatgcgtatcaataatgattgaagaagtgatgagatccagatggagtagaaagatgctgatgactggaacattggctgttttcctccttcttataatgggacaactgacatggaatgacctgattaggttatgcatcatggttggagctaatgcttcagacaggatggggatgggaacaacgtacctggccttgatggctactttcaaaatgagaccaatgttcgctgttgggctactatttcgcagactaacatccagagaagttcttcttctcacgattggattaagcctggtggcatctgtggagttaccaaattctttggaggagctaggggatggacttgcaatgggtatcatgatgttaaaattattgactgaatttcagccacaccagttatggaccaccttactgtctctgacatttatcaaaacaactctttcattggattatgcatggaggacaatggccatggtgctgtcaatcgtatctctctttcctttatgtctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactccttaaaaatgatgtgccgttggccggcccactaatagctggaggcatgctaatagcatgttatgtcatatccggaagctcagccgatttatcattggagaaagcggctgaggtatcctgggaagaagaagcagaacactctggtacctcacacaacatattagtagaggtccaagatgatggaactatgaaaataaaggatgaagagagggatgacacactcaccatactcctcaaagcaactttgctggcagtctcaggagtgtacccaatgtcaataccagcaacttttttcgtgtggtatttttggcagaaaaagaaacagagatcaggagtgttatgggacacacccagccctccggaagtggaaagagcagttcttgatgatggcatctatagaatcctgcaaagaggactgttgggcaggtcccaagtaggagtgggagttttccaggacggcgtgttccacacaatgtggcacgtcaccaggggagctgtccttatgtaccaagggaagaggttagaaccaagctgggccagtgtcaaaaaggacttgatctcatatggaggaggttggagatttcaaggatcatggaacacgggagaagaggtgcaggtgatagccgttgaaccaggaaaaaatcctaaaaatgtacagacaacgccgggtaccttcaagactcccgaaggcgaagttggagccatagctctagattttaaacccggcacatctggatctcccatcgtgaacagagagggaaaaatagtaggtctttatggaaatggagtggtgacaacaagtggaacctacgtcagtgccattgcccaagctaagacatcacaagaagggcctctaccagagattgaggaggaggtgtttaagaaaaggaacttaacaataatggacctgcatccaggatcgggaaaaacaagaagatatcttccagccatagtccgtgaggccataaaaaggaaactgcgcacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatctccagtgagagttcccaattacaacatgattatcatggatgaagcacattttaccgatccagccagcatagcggccagagggtacatctcaactcgagtgggtatgggtgaagcagctgcgatctttatgacagccactcccccaggatcggtggaggcctttccacaaagtaatgcagttatccaagatgaggaaagagacattcctgagagatcatggaactcaggctacgactggatcactgattttccaggtaaaacagtctggtttgttccaagcattaagtcaggaaatgacattgctaactgtttaagaaagaacggaaaacgggtgatccaattgagcagaaaaacctttgacactgagtaccagaaaacaagaaacaatgactgggactatgttgtcacaacagacatttccgaaatgggggcaaatttccgggccgacagggtaatagacccaaggcggtgcttgaaaccagtgatactaaaagatggtccagagcgtgtcattctagccggaccgatgccagtgactgtggccagtgctgcccagagaagaggaagaattggaaggaaccaaaacaaggaaggtgatcagtacgtttatatgggacagcctttaaataatgatgaggatcacgctcattggacagaagcaaaaatgctccttgacaatataaacacaccagaagggatcattccagccctctttgagccagagagagaaaagagtgcagcaatagatggggagtacagactgcggggagaagcaaggaaaacgttcgtggagctcatgagaagaggagatctaccagtttggctatcctacaaagttgcctcagaaggtttccagtactccgacagaaggtggtgctttgacggggaaaggaacaaccaggtgttggaggagaacatggacgtggagatctggacaaaggaaggagaaaggaagaaattgcgaccccgctggttggatgccagaacatactctgatccactggcccttcgtgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgctatggaggaactaccagacaccatagaaacattgatgctcctagctttgatagctgtgctgactggtggagtgacgctgttcttcctatcaggaaaaggtctagggaaaacatccattggcctgctctgtgtgatggcctcaagcgcactgttatggatggccaatgtggagccacattggatagcggcctccatcatactagagttctttctgatggtgctgctcattccagagccagacagacagcgcactccacaggacaaccagctagcatacgtggtgataggtttgttattcatgatactgacagtggcagccaatgagatgggattattggaaaccacaaagaaagacctggggattggccatgtagccgccgaaaaccaacatcatgccacgatgctggacgtagacctacgcccagcttcagcctggaccctctatgcagtggccacaacagttatcactcccatgatgagacacacaattgaaaacacaacagcaaacatttccctgacagccattgcaaaccaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagttaggccaaataatgttactgatactttgtacatcacagattctcttgatgcggaccacatgggccctgtgtgaatccatcacactggctactggacccttgaccactctctgggagggatctccaggaaaattctggaataccacgatagcagtgtccatggcaaacatcttcaggggaagttatctagcaggagcaggtctggccttctcgttaatgaaatctttgggaggaggcaggagaggtacgggggctcaaggagaaacactgggagagaaatggaaaagacagttaaaccaactgagcaagtcagaattcaacacctacaaaaggagtgggattatggaggtggacagatccgaagccaaagagggattaaaaagaggagagacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtcaagggatacacaaaaggaggacctggacatgaggaacctatcccaatggcgacctatggatggaacctagtaaagctatactctggaaaagatgtattttttacaccacctgagaaatgtgatacccttctgtgtgatataggagagtcctctccgaatccaactatagaagaaggaagaacgttacgtgttctaaagatggtagaaccatggctcagaggaaaccaattctgcataaaaattctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatgactcacaggaagccaacatatgaaagagacgtggacttaggcgctggaacaagacatgtggcagtggaaccagaggtagccaacctagatattattggccagaggatagagaatataaaaaatgaacacaagtcaacatggcattatgatgaagacaatccatacaaaacatgggcctatcatggatcatatgaggtcaaaccatcaggatcagcctcatctatggtgaatggcgtggtgagattgctcacaaaaccatgggatgtcatccccatggtcacacaaatagccatgaccgataccacacccttcggacaacagagagtgtttaaagagaaagtagatacgcgcacgccgagagcaaaacgaggcacagcacaaattatggaggtgacagccaagtggctatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggaacttcataaacagggaaaatgtgccacgtgtgtctacaacatgatggggaagagagagaaaaaattgggagagtttggaaaggcaaaaggaagtcgtgcaatatggtacatgtggctgggagcacgctttctagagttcgaagcccttggtttcatgaatgaagatcactggttcagtagagagaattcattcagtggagtggaaggagaaggactgcacaaacttggatacatactcagagacatatcaaagatcccggggggaaacatgtatgcagatgacacagccggatgggacacaagaataacagaggatgatcttcagaatgaggccaaaatcactgacatcatggagcctgaacacgctctattagctacgtcaatttttaagctgacctaccaaaacaaggtggtaagggtgcaaagaccagcaaaaaatggaaccgtgatggatgttatatccagacgagaccagagaggaagtgggcaggtcggaacctatggcttaaatactttcaccaatatggaggtccaactaataagacaaatggagtctgaaggaatctttttacccagcgaattggaaacccccaatctagctgagagagttcttaactggttggaaaaacatggcactgaaaggctgaaaagaatggcaattagcggagatgattgtgtggtgaaaccagttgatgacaggtttgcaacagccttaatagctctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctaagactagcggctaatgctatctgttcagctgtcccagttgactgggttccaaccagccgcacaacctggtcaatccatgctcaccatcaatggatgacaacagaagatatgttatcagtgtggaatagggtttggatagaggaaaacccatggatggaggataaaactcatgtatccagctgggaagaagtcccatacttagggaaaagggaagatcaatggtgtggatccctgataggcttgacagcgagggccacttgggccactaacatacaagtagccataaaccaagtgagaaggctcatcggaaatgagaattatctagattacatgacatcaatgaagagattcaagaatgagagtgatcccgaaggggcactctggtaa

SEQ ID NO: 5577 - RNA, 9879 nt, synthetic construct
  misc_feature 1..9879: note = derived and/or modified CDS sequence (wt) from DENV-1__FJ410174__SS-prME
  source 1..9879: mol_type = other RNA
tctgtgaccatgctcctcatgctgctgcccacagccctggcgttccatttgaccacacgagggggagagccacacatgatagttagtaagcaggaaagaggaaagtcactgttgtttaagacctctgcaggcatcaatatgtgcactctcattgcgatggatttgggagagttatgcgaggacacaatgacctacaaatgcccccggatcactgaggcggaaccagatgacgttgactgctggtgcaatgccacagacacatgggtgacctatgggacatgttctcaaaccggcgaacaccgacgagacaaacgttccgtggcactggccccacacgtgggacttggtctagaaacaagaaccgaaacatggatgtcctctgaaggtgcctggaaacaaatacaaaaagtggagacttgggctttgagacacccaggattcacggtgacagccctttttttagcacatgccataggaacatccattactcagaaagggatcattttcattttgctgatgctagtaacaccatcaatggccatgcgatgtgtgggaataggcaacagagacttcgttgaaggactgtcaggagcaacgtgggtggacgtggtattggagcatggaagctgcgtcaccaccatagcaaaagataaaccaacattggacattgaactcttgaagacggaggtcacaaaccctgccgtcttgcgcaaactgtgcattgaagctaaaatatcaaacaccaccaccgattcaaggtgtccaacacaaggagaggccacactggtggaagaacaagactcgaactttgtgtgtcgacgaacgtttgtggacagaggctggggtaatggctgcggactatttggaaaaggaagcctactgacgtgtgctaagttcaagtgtgtgacaaaactagaaggaaagatagttcaatatgaaaacttaaaatattcagtgatagtcactgtccacactggggaccagcaccaggtgggaaacgagactacagaacatggaacaattgcaactataacacctcaagctcctacgtcggaaatacagctgactgactacggagccctcacattggactgctcacctagaacagggctggactttaatgagatggttctattgacaatgaaagaaaaatcatggcttgtccacaaacaatggtttctagacttaccactgccttggacttcaggagcttcaacatctcaagagacttggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacacctgaaatgcagactaaaaatggataaactgactttaaaagggatgtcatatgtaatgtgcacaggctcatttaagctagagaaggaagtggctgagacccagcatggaactgttctagtgcaggttaaatacgaaggaacagatgcgccatgcaagatccctttttcggcccaagatgagaaaggagtgacccagaatgggagattgataacagccaaccccatagtcactgacaaagaaaaaccagtcaacattgagacagaaccaccttttggtgagagctacatcgtggtaggggcaggtgaaaaagctttgaaactgagctggttcaagaaagggagcagcatagggaaaatgttcgaagcaactgcccgaggagcacgaaggatggctatcctgggagacaccgcatgggactttggctctataggaggagtgttcacatcagtgggaaaattggtacaccaggtttttggagccgcatatggggttctgttcagcggtgtttcttggaccatgaaaataggaatagggattctgctgacatggttgggattaaattcaaggagcacgtcactttcgatgacgtgcattgcggttggcatggtcacactgtacctaggagtcatggttcaagcggactcgggatgtgtaatcaactggaagggcagagaactcaaatgtggaagtggtatttttgtcactaatgaagtccacacttggacagagcaatacaaattccaggctgactccccaaaaagactgtcagcagccattgggaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgattaggccacaacccatggaacatagatactcatggaaaagctggggaaaagccaaaatcataggagcagacatacagaataccaccttcatcatcgacggcccagatactccagaatgccccgatgaccaaagagcgtggaacatttgggaagttgaagactatgggtttggaattttcacgacaaacatatggctgaaattgcgcgactcctacacccaaatgtgtgaccaccggctaatgtccgctgccatcaaagacagcaaggcagtccatgctgacatggggtactggatagaaagtgaaaagaacgagacctggaagctagcgagagcctccttcatagaagtcaagacatgtatctggccaaaatcccacactctatggagtaatggagttttggaaagtgaaatgataatcccaaagatatatggaggaccaatatctcagcacaactacagaccagggtatttcacacaaacagcagggccatggcacctaggcaagttggaattggattttgacttgtgtgaaggtaccacagttgttgtggatgaacattgtggaaatcgaggcccatctctcagaactacaacagtcacaggaaagataatccatgaatggtgttgcagatcctgcacgttaccccccttacgcttcagaggagaagacggatgttggtatggcatggaaatcagaccagttaaggagaaggaggaaaacctagttaggtcaatggtctctgcagggtcaggagaagtggacagtttttcactagggatactatgcgtatcaataatgattgaagaagtgatgagatccagatggagtagaaagatgctgatgactggaacattggctgttttcctccttcttataatgggacaactgacatggaatgacctgattaggttatgcatcatggttggagctaatgcttcagacaggatggggatgggaataacgtacctggccttgatggctactttcaaaatgagaccaatgttcgctgttgggctactatttcgcagactaacatccagagaagttcttcttctcacgattggattaagcctggtggcatccgtggagttaccaaattctttggaggagctaggggatggacttgcaatgggtatcatgatgttaaaattattgactgaatttcagccacaccagttatggaccaccttactgtctttgacatttatcaaaacaactctttcattggattatgcatggaggacaatggctatggtgctgtcaatcgtatctctctttcctttatgtctgtctacgacctcccaaaaaacaacatggcttccggtgctgttaggatcttttggatgcaaaccattaaccatgtttcttataacagaaaacaaaatctggggaaggaagagttggcccctcaatgaaggaattatggctattggaatagtcagcattctactaagttcactccttaaaaatgatgtgccgttggccggcccactaatagctggaggcatgctaatagcatgttatgtcatatccggaagctcagccgatttatcattggagaaagcggctgaggtatcctgggaagaagaagcagaacactctggtacctcacacaacatattagtagaggtccaagatgatggaactatgaaaataaaagatgaagagagggatgacacactcaccatactcctcaaagcaactctgctggcagtctcaggagtgtacccaatgtcaataccagcaactcttttcgtgtggtatttttggcagaaaaagaaacagagatcaggagtgttatgggacacacccagccctccggaagtggaaagagcagttcttgatgatggcatctatagaatcctgcaaagaggactgttgggcaggtcccaagtgggagtgggagttttccaagacggcgtgttccacacaatgtggcacgtcaccaggggagctgtccttatgtaccaagggaagaggttggaaccaagctgggccagtgtcaaaaaggacttgatctcatatggaggaggttggagatttcaaggatcatggaacacgggagaagaggtgcaggtgatagccgttgaaccaggaaaaaatcccaaaaatgtacagacaacgccgggtaccttcaagactcccgaaggcgaagttggagccatagctctagattttaaacccggcacatctggatctcccatcgtgaacagagagggaaaaatagtaggtctttatggaaatggagtggtgacaacaagtggaacctacgtcagtgccattgcccaagctaaaacatcacaagaagggcctctaccagagattgaggaggaggtgtttaagaaaaggaacttaacaataatggacctgcatccaggatcgggaaaaacaagaagatatcttccagccatagtccgtgaggccataaaaaggaaactgcgcacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatctccagtgagagttcccaattacaacatgattatcatggatgaagcacattttaccgatccagccagcatagcggccagagggtacatctcaactcgagtgggtatgggtgaagcagctgcgatctttatgacagccactcccccaggatcggtggaggcctttccacaaagcaatgcagttatccaagatgaggaaagagacattcctgagagatcatggaactcaggctacgactggatcactgattttccaggtaaaacagtctggtttgttccaagcattaagtcaggaaatgacattgctaactgtttaagaaagaacggaaaacgggtgatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccagtgatactaaaagatggtccagagcgtgtcattctagccggaccgatgccagtgactgtggccagtgctgcccagagaagaggaagaattggaaggaaccaaaacaaggaaggtgatcagtacgtttatatgggacagcctttaaataatgatgaggatcacgctcattggacagaagcaaaaatgctccttgacaatataaacacaccagaagggatcattccagccctctttgagccagagagagaaaagagtgcagcaatagatggggagtacagactgcggggagaagcaaggaaaacgttcgtggagctcatgagaagaggagatctaccagtttggctatcctacaaagttgcctcagaaggtttccagtactccgacagaaggtggtgctttgacggggaaaggaacaaccaggtgttggaggagaacatggacgtggagatctggacaaaggaaggagaaagaaagaaattgcgaccccgctggttggatgccagaacatactctgatccactggcccttcgtgagtttaaagagtttgcagcaggaagaagaagtgtctcaggtgacctaatactggaaatagggaaacttccacaacatttgacgctaagagcccagaatgctctggataacttggtcatgttgcacaattccgaacaaggaggaaaagcctatagacatgctatggaggaactaccagacaccatagaaacattgatgctcctagctttgatagctgtgctgactggtggagtgacgctgttcttcctatcaggaaaaggtctagggaaaacatccattggcctgctctgtgtgatggcctcaagcgcactgttatggatggccaatgtggagccacattggatagcggcctccatcatactagagttctttctgatggtgctgctcattccagagccagacagacagcgcactccacaggacaaccagctagcatacgtggtgataggtttgttattcatgatactgacagtggcagccaatgagatgggattattggaaaccacaaagaaagacctggggattggccatgtagctgccgaaaaccaacaccatgccacgatgctggacgtagacctacgcccagcttcagcctggaccctctatgcagtagccacaacagttatcactcccatgatgagacacacaattgaaaacacaacagcaaacatttccctgacagccattgcaaaccaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagttaggccaaataatgttactgatactttgtacatcacagattctcttgatgcggaccacatgggccctgtgtgaatccatcacactggctactggacccttgaccactctctgggagggatctccaggaaaattctggaataccacgatagcagtgtccatggcaaacatcttcaggggaagttatctagcaggagcagctctggccttctcgttaatgaaatctttgggaggaggcaggagaggtacgggggctcaaggagaaacactgggagagaaatggaaaagacagttaaaccaactgagcaagtcagaattcaacacctacaaaaggagtgggattatggaggtggacagatccgaagccaaagagggattaaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtcaagggatacacaaaaggaggacctggacatgaggaacctatcccaatggcgacctatggatggaacctagtaaagctatactctggaaaagatgtattttttacaccacctgagaaatgtgatacccttctgtgtgatataggagagtcctctccgaatccaactatagaagaaggaagaacgttacgtgttctaaagatggtagaaccatggctcagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatgactcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaagacaatccatacaaaacatgggcctatcatggatcatatgaggtcaaaccatcaggatcagcctcatctatggtgaatggcgtggtgagattgctcacaaaaccatgggatgtcatccccatggtcacacaaatagccatgaccgataccacacccttcggacaacaaagagtgtttaaagagaaagtagatacgcgcacgccgagagcaaaacgaggcacagcacaaattatggaggtgacagccaagtggctatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggaacttcataaacagggaaaatgtgccacgtgtgtctacaacatgatggggaagagagagaaaaaattgggagagtttggaaaggcaaaaggaagtcgtgcaatatggtacatgtggctgggagcacgctttctagagttcgaagcccttggtttcatgaatgaagatcactggttcagtagagagaattcattcagtggagtggaaggagaaggactgcacaaacttggatacatactcagagacatatcaaagatcccggggggaaacatgtatgcagatgacacagccggatgggacacaagaataacagaggatgatcttcagaatgaggctaaaatcactgacatcatggaggctgaacacgctctattggctacgtcaatttttaagctgacctaccaaaacaaggtggtaagggtgcaaagaccagcaaaaaatggaaccgtgatggatgttatatccagacgagaccagagaggaagtgggcaggtcggaacctatggcttaaatactttcaccaatatggaggtccaactaataagacaaatggagtctgaaggaatctttttacccagcgaattggaaacccccaatctagctgagagagttcttgactggttggaaaaacatggcactgaaaggctgaaaagaatggcaattagcggagatgattgtgtggtgaaaccagttgatgacaggtttgcaacagccttaatagctctgaatgacatgggaaaagtaagaaaagacataccgcagtgggaaccttcaaaaggatggaatgactggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctaagactagcggctaatgctatctgttcagctgtcccagttgactgggtcccaaccagccgcacaacctggtcaatccatgctcaccatcaatggatgacaacagaagatatgttatcagtgtggaatagggtttggatagaggaaaacccatggatggaggataaaactcatgtatccagctgggaagaagtcccatacttagggaaaagggaagatcaatggtgtggatccctgataggcttgacagcgagggccacttgggccactaacatacaagtagccataaaccaagtgagaaggctcatcgggaatgagaattatctagattacatgacatcaatgaagagattcaagaatgagagtgatcccgaaggggcactctggtaa

SEQ ID NO: 5578 - RNA, 9879 nt, synthetic construct
  misc_feature 1..9879: note = derived and/or modified CDS sequence (wt) from DENV-1__FJ410175__SS-prME
  source 1..9879: mol_type = other RNA
tctgtgaccatgctcctcatgctgctgcccacagccctggcgttccatttgaccacacgagggggagagccacacatgatagttagtaagcaggaaagaggaaagtcactgttgtttaagacctctgcaggcatcaatatgtgcactctcattgcgatggatttgggagagttatgcgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggacttggtctagaaacaagaaccgaaacatggatgtcctctgaaggtgcctggaaacaaatacaaaaagtggagacttgggctttgagacacccagggttcacggtgacagccctttttttagcacatgccataggaacatccattactcagaaagggatcattttcattttgctgatgctagtaacaccatcaatggccatgcgatgtgtgggaataggcaacagagacttcgttgaaggactgtcaggagcaacgtgggtggacgtggtattggagcatggaagctgcgtcaccaccatggcaaaagataaaccaacattggacattgaactcttgaagacggaggtcacaaaccctgccgtcttgcgcaaactgtgcattgaagctaaaatatcaaacaccaccaccgattcaaggtgtccaacacaaggagaggccacactggtggaagaacaagactcgaactttgtgtgtcgacgaacgtttgtggacagaggctggggtaatggctgcggactatttgggaaaggaagcctactgacgtgtgctaagttcaagtgtgtgacaaaactagaaggaaagatagttcaatatgaaaacttaaaatattcagtgatagtcactgtccacactggggaccagcaccaggtgggaaacgagactacagaacatggaacaattgcaactataacacctcaagctcctacgtcggaaatacagctgactgactacggagccctcacattggactgctcacctagaacagggctggactttaatgagatggttctattgacaatgaaagaaaaatcatggcttgtccacaaacaatggtttctagacttaccactgccttggacttcaggagcttcaacatctcaagagacttggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacacctgaaatgcagactaaaaatggataaactgactttaaaagggatgtcatatgtaatgtgcacaggctcatttaagctagagaaggaagtggctgagacccagcatggaactgttctagtgcaggttaaatacgaaggaacagatgcgccatgcaagatccctttttcggcccaagatgagaaaggagtgacccagaatgggagattgataacagccaaccccatagtcactgacaaagaaaaaccagtcaacattgagacagaaccaccttttggtgagagctacatcgtggtaggggcaggtgaaaaagctttgaaactgagctggttcaagaaagggagcagcatagggaaaatgttcgaagcaactgcccgaggagcacgaaggatggctatcctgggagacaccgcatgggacttcggctctataggaggagtgttcacatcagtgggaaaattggtacaccaggtttttggagccgcatatggggttctgttcagcggtgtttcttggaccatgaaaataggaatagggattctgctgacatggttgggattaaattcaaggagcacgtcactttcgatgacgtgcattgcggttggcatggtcacactgtacctaggagtcatggttcaagcggactcgggatgtgtaatcaactggaagggcagagaactcaaatgtggaagtggtatttttgtcactaatgaagtccacacttggacagagcaatacaaattccaggctgactccccaaaaagactgtcagcagccattgggaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgattaggccacaacccatggaacatagatactcatggaaaagctggggaaaagccaaaatcataggagcagacatacagaataccaccttcatcatcgacggcccagatactccagaatgccccgatgaccaaagagcgtggaacatttgggaagttgaagactatgggtttggaattttcacgacaaacatatggctgaaattgcgcgactcctacacccaaatgtgtgaccaccggctaatgtccgctgccatcaaagacagcaaggcagtccatgctgacatggggtactggatagaaagtgaaaagaacgagacctggaagctagcgagagcctccttcatagaagtcaagacatgtatctggccgaaatcccacactctatggagtaatggagttttggaaagtgaaatgataatcccaaagatatatggaggaccaatatctcagcacaactacagaccagggtatttcacacaaacagcagggccatggcacctaggcaagttggaattggattttgacttgtgtgaaggtaccacagttgttgtggatgaacattgtggaaatcgaggcccatctctcagaactacaacagtcacaggaaagataatccatgaatggtgttgcagatcctgcacgttaccccccttacgcttcagaggagaagacggatgttggtatggcatggaaatcagaccagttaaggagaaggaggaaaacctagttaggtcaatggtctctgcagggtcaggagaagtggacagtttttcactagggatactatgtgtatcaataatgattgaagaagtgatgagatccagatggagtagaaagatgctgatgactggaacattggctgttttcctccttcttataatgggacaactgacatggaatgacctgattaggttatgcatcatggttggagctaatgcttcagacaggatggggatgggaacaacgtacctggccttgatggctactttcaaaatgagaccaatgttcgctgttgggctactatttcgcagactaacatccagagaagttcttcttctcacgattggattaagcctggtggcatccgtggagttaccaaattctttggaggagctaggggatggacttgcaatgggtatcatgatgttaaaattattgactgaatttcagccacaccagttatggaccaccttactgtctttgacatttatcaaaacaactctttcattggattatgcatggaggacaatggctatggtgctgtcaatcgtatctctctttcctttatgtctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactccttaaaaatgatgtgccgttggccggcccactaatagctggaggcatgctaatagcatgttatgtcatatccggaagctcagccgatttatcattggagaaagcggctgaggtatcctgggaagaagaagcagaacactctggtacctcacacaacatattagtagaggtccaagatgatggaactatgaaaataaaagatgaagagagggatgacacactcaccatactcctcaaagcaactctgctggcagtctcaggagtgtacccaatgtcaataccagcaactcttttcgtgtggtatttttggcagaaaaagaaacagagatcaggagtgttatgggacacacccagccctccggaagtggaaagagcagttcttgatgatggcatctatagaatcctgcaaagaggactgttgggcaggtcccaagtaggagtgggagttttccaagacggcgtgttccacacaatgtggcacgtcaccaggggagctgtccttatgtaccaagggaagaggttggaaccaagctgggccagtgtcaaaaaggacttgatctcatatggaggaggttggagatttcaaggatcatggaacacgggagaagaggtgcaggtgatagctgttgaaccaggaaaaaatcccaaaaatgtacagacaacgccgggtaccttcaagactcccgaaggcgaagttggagccatagctctagattttaaacccggcacatctggatctcccatcgtgaacagagagggaaaaatagtaggtctttatggaaatggagtggtgacaacaagtggaacctacgtcagtgccattgcccaagctaaaacatcacaagaagggcctctaccagagattgaggaggaggtgtttaagaaaaggaacttaacaataatggacctgcatccaggatcgggaaaaacaagaagatatcttccagccatagtccgtgaggccataaaaaggaaactgcgcacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatctccagtgagagttcccaattacaacatgattatcatggatgaagcacattttaccgatccagccagcatagcggccagagggtacatctcaactcgagtgggtatgggtgaagcagctgcgatctttatgacagccactcccccaggatcggtggaggcctttccacaaagcaatgcagttatccaagatgaggaaagagacatccctgagagatcatggaactcaggctacgactggatcactgattttccaggtaaaacagtctggtttgttccaagcattaagtcaggaaatgacattgctaactgtttaagaaagaacggaaaacgggtgatccaattgagcagaaaaacctttgacactgagtaccagaaaacaaaaaacaatgattgggactatgttgtcacaacagacatttccgaaatgggggcaaatttccgggccgacagggtaatagacccaaggcggtgcttgaaaccagtgatactaaaagatggtccagagcgtgtcattctagccggaccgatgccagtgactgtggccagtgctgcccagagaagaggaagaattggaaggaaccaaaacaaggaaggtgatcagtacgtttatatgggacagcctttaaataatgatgaggatcacgctcattggacagaagcaaaaatgctccttgacaatataaacacaccagaagggatcattccagccctctttgagccagagagagaaaagagtgcagcaatagatggggagtacagactgcggggagaagcaaggaaaacgttcgtggagctcatgagaagaggagatctaccagtttggctatcctacaaagttgcctcagaaggtttccagtactccgacagaaggtggtgctttgacggggaaaggaacaaccaggtgttggaggagaacatggacgtggagatctggacaaaggaaggagaaaggaagaaattgcgaccccgctggttggatgccagaacatactctgatccactggcccttcgtgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgctatggaggaactgccagacaccatagaaacattgatgctcctagctttgatagctgtgctgactggtggagtgacgctgttcttcctatcaggaaaaggtctagggaaaacatccattggcctgctctgtgtgatggcctcaagcgcactgttatggatggccaatgtggagccacattggatagcggcctccatcatactagagttctttctgatggtgctgctcattccagagccagacagacagcgcactccacaggacaaccagctagcatacgtggtgataggtttgttattcatgatactgacagtggcagccaatgagatgggattattggaaaccacaaagaaagacctggggattggccatgtagccgccgaaaaccaacaccatgccacgatgctggacgtagacctacgcccagcttcagcctggaccctctatgcagtagccacaacagttatcactcccatgatgagacacacaattgaaaacacaacggcaaacatttccctgacagccattgcaaaccaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagttaggccaaataatgttactgatactttgtacatcacagattctcttgatgcggaccacatgggccctgtgtgaatccatcacactggctactggacccctgaccactctctgggagggatctccaggaaaattctggaataccacgatagcagtgtccatggcaaacatcttcaggggaagttatctagcaggagcaggtctggccttctcgttaatgaaatctttgggaggaggcaggagaggtacgggggctcaaggagaaacactgggagagaaatggaaaagacagttaaaccaactgagcaagtcagaattcaacacctacaaaaggagtgggattatggaggtggacagatccgaagccaaagagggattaaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtcaagggatacacaaaaggaggacctggacatgaggaacctatcccaatggcgacctatggatggaacctagtaaagctatactctggaaaagatgtattttttacaccacctgagaaatgtgatacccttctgtgtgatataggagagtcctctccgaatccaactatagaagaaggaagaacgttacgtgttctaaagatggtagaaccatggctcagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatgactcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaagacaatccatacaaaacatgggcctatcatggatcatatgaggtcaaaccatcaggatcagcctcatctatggtgaatggcgtggtgagattgctcacaaaaccatgggatgtcatccccatggtcacacaaatagctatgaccgataccacacccttcggacaacagagagtgtttaaagagaaagtagatacgcgcacgccgagagcaaaacgaggcacagcacaaattatggaggtgacagccaagtggctatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggaacttcataaacagggaaaatgtgccacgtgtgtctacaacatgatggggaagagagagaaaaaattgggagagtttggaaaggcaaaaggaagtcgtgcaatatggtacatgtggctgggagcacgctttctagagttcgaagcccttggtttcatgaatgaagatcactggttcagtagagagaattcattcagtggagtggaaggagaaggactgcacaaacttggatacatactcagagacatatcaaagatcccggggggaaacatgtatgcagatgacacagccggatgggacacaagaataacagaggatgatcttcagaatgaggctagaatcactgacatcatggagcctgaacacgctctattggctacgtcaatttttaagctgacctaccaaaacaaggtggtaagggtgcaaagaccagcaaaaaatggaaccgtgatggatgttatatccagacgagaccagagaggaagtgggcaggtcggaacctatggcttaaatactttcaccaatatggaggtccaactaataagacaaatggagtctgaaggaatctttttacccagcgaattggaaacccccaatctagctgagagagttcttgactggttggaaaaacatggcactgaaaggctgaaaagaatggcaattagcggagatgattgtgtggtgaaaccagttgatgacaggtttgcaacagccttaatagctctgaatgacatgggaaaagtaagaaaagacataccgcagtgggaaccttcaaaaggatggaatgactggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctaagactagcggctaatgctatctgttcagctgtcccagttgactgggtcccaaccagccgcacaacctggtcaatccatgctcaccatcaatggatgacaacagaagatatgttatcagtgtggaatagggtttggatagaggaaaacccatggatggaggataaaactcatgtatccagctgggaagaagtcccatacttagggaaaagggaagatcaatggtgtggatccctgataggcttgacagcgagggccacttgggccactaacatacaagtagccataaaccaagtgagaaggctcatcgggaatgagaattatctagattacatgacatcaatgaagagattcaagaatgagagtgatcccgaaggggcactctggtaa

SEQ ID NO: 5579 - RNA, 9879 nt, synthetic construct
  misc_feature 1..9879: note = derived and/or modified CDS sequence (wt) from DENV-1__FJ562105__SS-prME
  source 1..9879: mol_type = other RNA
tccgtgaccatgctcctcatgctgctgcccacagtcctggctttccatttgaccacacgagggggagagccacacatgatagttggtaagcaggaaagaggaaagtcactcttgttcaagacctctgcaggtgtcaatatgtgcactctcatcgcgatggatttgggagagttgtgtgaggacacaatgacttacaaatgcccccggatcactgaggcggaaccagatgacgttgactgctggtgcaatgccacagacacatgggtgacctatgggacgtgttctcaaaccggtgaacaccgacgagacaaacgttccgtggcactggccccacacgtgggacttggtctagaaacaagaaccgaaacatggatgtcctcagaaggcgcctggaaacaaatacaaaaagtggagacttgggctttgagacatccaggattcacggtgatagctttttttttagcacatgccataggaacatccatcactcagaaagggatcattttcattctgctgatgctggtaacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaattgtgcattgaagctaaaatatcaaacaccaccaccgattcaagatgtccaacacaaggagaggctacactagtggaagaacaagacgcgaactttgtgtgtcgacgaacgtttgtggacagaggctggggcaatggctgcggactatttggaaaaggaagcctactgacgtgtgctaagttcaagtgtgtgacaaaactggaaggaaagatagttcaatatgaaaacttaaaatattcagtgatagtcactgtccacacaggggaccagcaccaggtgggaaacgagactacagaacatggaacaattgcaaccataacacctcaagctcctacgtcggaaatacagctgaccgactacggagccctcacactggactgctcacccagaacagggctggactttaatgagatggtgctattgacaatgaaagaaaaatcatggcttgtccacaaacaatggtttctagacttaccactgccttggacttcgggggcttcaacatcccaagagacttggaacagacaagatttgctggtcacattcaagacagctcatgcaaaaaagcaagaagtagtcgtactgggatcacaggaaggagcaatgcacactgcgttgaccggggcgacagaaatccagacgtcaggaacgacaacaatctttgcaggacacctgaaatgcagactaaaaatggataaactgactttaaaagggatgtcatatgtgatgtgcacaggctcatttaagctagagaaggaagtggctgagacccagcatgggactgtcctagtgcaggttaaatacgaaggaacagatgcgccatgtaagatccccctttcgacccaagatgagaaaggagtgacccagaatgggagattgataacagccaatcccatagttactgacaaagaaaaaccagtcaacattgagacagaaccaccttttggtgagagctacatcatagtaggggcaggtgaaaaagctttgaaactaagctggttcaagaaaggaagcagcatagggaaaatgttcgaagcaaccgcccgaggagcacgaaggatggctatcctgggagacaccgcatgggacttcggctctataggaggagtgttcacgtctgtgggaaaattggtacaccaggtttttggaaccgcatacggggtcctgttcagcggcgtttcttggaccatgaaaataggaatagggatcctgctgacatggttgggattaaattcaaggagcgcgtcgctttcgatgacgtgcattgcagttggcatggttacactgtacctaggagtcatggttcaagcggactcgggatgtgtaatcaactggaagggcagagaactcaagtgtggaagtggcatttttgtcactaatgaagtccacacttggacagagcaatacaaattccaggctgactccccaaaaagactgtcagcagccattgggaaggcatgggaggagggcgtgtgtggagttcgatcagccacgcgtcttgagaatatcatgtggaagcaaatatcaaatgaattgaaccacattctactcgaaaatgacatgaaattcacagtggttgtaggagatgctaatggaattttggcccaggggaaaaaaatgatcaggccacaacccatggaacacaaatactcatggaaaagctggggaaaagccaagatcataggagcagacatacagaataccaccttcatcatcgacggcccagacactccagaatgccccgatgaccaaagagcgtggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacctggaagttagcgagagcctccttcatagaagtcaagacatgcatttggccgaaatcccacactctatggagtaatggagttttggaaagtgaaatgataatcccaaagatatatggaggaccaatatctcagcacaattacagaccagggtatttcacacaaacagcagggccatggcacctaggcaagttggaattggattttgacttgtgtgaaggcaccacagttgttgtggatgaacattgtggaaatcgaggtccatctctcagaactacaacagtcacaggaaagataatccatgaatggtgttgcagatcctgcacgttaccccccttacgcttcagaggagaagacggatgttggtatggcatggaaatcagaccagttaaggagaaggaggagaacctagttaggtcaatggtctctgcagggtcaggagaagtggacagtttttcattgggaatattatgcttatcaataatgattgaagaagtgatgagatccagatggagtagaaagatgctgatgactggaacactggctgttttcctccttcttataatgggacaactgacatggaatgatctgattaggttatgcatcatggttggagctaatgcttctgacaggatggggatgggaacaacgtacctagccttgatggctactttcaaaatgagaccaatgttcgccgttgggttattatttcgcagactaacatccagagaggttcttcttctcacgattggattaagcctggtggcatccgtggagctaccaaattctttggaggagctaggggatggacttgcaatgggtatcatgatgttaaaactattgactgaatttcagccacaccagttatggaccaccttactgtctctgacatttatcaaaacaactctttcattggattatgcatggaagacaatggctatggtactgtcaatcgtatctctctttcctttatgtctgtctacgacctcccaaaaaacaacatggcttccggtgctgttaggatcttttggatgcaaaccattaaccatgtttctcataacagaaaacaaaatctggggaaggaaaagttggcccctcaatgaaggaattatggccattggaatagtcagcattctactaagttcactcctcaaaaatgatgtgccgttggccggcccactaatagctggaggcatgctaatagcatgttatgtcatatccggaagctcagccgatttatcattggagaaagcggctgaggtatcctgggaagaagaagcagaacactccggtacctcacacaacatattagtagaggtccaagatgatggaactatgaaaataaaagatgaagagagggatgacacactcaccatcctcctcaaagcaactctgctggcagtttcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactattgggcaggtcccaagtgggagtgggagttttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaaaaatgtacagacaacgccgggtaccttcaagactcccgaaggtgaagttggagccgtagctctagattttaaacccggcacatctggatctcccattgtgaacagagagggaaaaatagtaggtctttatggaaatggagtggtgacaacaagtggaacctacgtcagtgctattgcccaagctaaagcatcacaagaagggcccctaccagagattgaggacgaggtgtttaagaaaagaaacttaacaataatggacctgcatccaggatcaggaaaaacaagaagatatcttccagccatagtccgtgaggccataaaaaggaaactgcgcacgttaatcttggctcccacaagagttgtcgcctctgaaatggcagaagcgctcaagggaatgccaataagatatcagacaacagcagtgaagagtgaacacacaggaagggagatagttgatctcatgtgccacgccacttttaccatgcgtctcttatctccagtgagagttcccaattacaacatgattatcatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaagaaagagacattcctgagagatcatggaactcaggctacgattggatcactgattttccaggtaaaacagtctggtttgttccaagcattaaatcaggaaatgacattgccaactgtttaagaaagaacggaaaacgggtgatccaattgagcagaaaaacctttgacaccgagtaccagaaaacaaaaaacaatgactgggactatgttgtcacaacagacatttccgaaatgggagcaaatttcagggccgacagggtaatagacccaaggcggtgcttgaaaccggtaatactaaaagatggtccagagcgcgtcattttagctggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaacataaacacaccagaagggatcatcccagccctctttgagccagagagagaaaagagcgcagcaatagacggggagtacagactgcggggagaagcaaggaaaacgttcgtggagctcatgagaagaggagatctaccagtttggctatcctacaaagttgcctcagaaggttttcagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccactggccctgcgcgagttcaaagagtttgcagcaggaagaagaagtgtctcaggtgacctaatcttggaaatagggaaacttccacaacatttgacgctaagagcccagaatgctctggataacttggtcatgttgcacaattccgaacaaggaggaaaagcctatagacatgctatggaggaactaccagacaccatagaaacattgatgctcctagctttgatagctgtgctgactggtggagtgatgctgttcttcctatcaggaaaaggtctagggaaaacatccatcggcctgctctgtgtgatggcctcaagcgcactgttatggatggccagtgtggagccccattggatagcggcctccatcatactagagttctttctaatggtgctgctcattccagagccagacagacagcgcactccacaggacaaccagctagcgtatgtagtgataggtttgttattcatgatactgacagtggcagccaatgagatgggattattggaaaccacaaagaaagacctggggattggccatgtagccgccgaaaaccaccaccacgttacaatgctggacgtagacctacgtccagcttcagcctggaccctctatgcggtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgctgatgttagtggctcattatgccataattggaccaggactgcaagcaaaggccactagagaagctcaaaaaaggacagcggccggaataatgaaaaatccaaccgtagatgggattgttgcaatagacttggatcctgtggtttatgatgcaaaatttgaaaaacagctaggccaaataatgttactgatactttgtacatcacagattctcttgatgcggaccacatgggccttgtgtgagtccatcacactggctaccggacccttgaccactctctgggagggatctccaggaaaattctggaataccacgatagcagtgtccatggcaaacatcttcaggggaagttatctagcaggagcaggtctggccttctcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatctgaagccaaagagggattgaaaagaggagaaacaaccaaacatgcagtgtcgagaggaacagccaaactgaggtggtttgtggagaggaaccttgtgaaaccagaagggaaagtcatagatctcggttgtggaagaggtggctggtcatattattgtgctgggctgaagaaagtcactgaagtgaagggatacacaaaaggaggacctgggcatgaggaacctatcccaatggcgacttatggatggaacctagtaaagctacactctggaaaagatgtattttttacaccacctgagaaatgtgatacccttctgtgtgatattggtgagtcctctccgaatccaactatagaagaaggaagaacgttacgtgttctaaagatggtggaaccatggcttggaggaaaccaattttgcataaaaatcctaaatccttatatgccaagtgtggtagaaactctggagcaaatgcaaaggaaacatggagggatgctagtgagaaacccactctcaagaaattccacccatgaaatgtactgggtttcatgtggaacaggaaacattgtgtcggcagtgaacatgacatccagaatgttactgaatcgattcacaatggcgcataggaagccaacatatgaaagagacgtggacttaggcgctggaacaagacatgtggcagtggaaccagaggtagccaacctaggtatcattggccagagaatagagaatataaaaaatgaacacaagtcaacatggcattatgatgaagacaatccatacaaaacatgggcctatcatggatcatatgaggtcaagccatcaggatcagcctcatctatggtgaatggcgtggtgagattgctcacaaaaccatgggatgttatccccatggtcacacaaatagctatgactgataccacacccttcggacaacagagagtgtttaaagagaaagttgatacgcgcacaccaagagcaaaacgaggcacagcacaaattatggaggtgacagccaaatggttatgggatttcctttccagaaacaaaaaacccagaatctgcacaagagaggagttcataagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgcgccacgtgtgtctacaacatgatggggaagagagagaaaaaattaggagagtttggaaaggcaaaaggaagtcgtgcaatatggtacatgtggctgggagcacgctttctagagttcgaagcccttggtttcatgaatgaagatcactggttcagtagagagaattcactcagtggagtggaaggagaaggactgcacaaacttggatacatactcagagacatatcaaagattccggggggaaacatgtatgcagatgatacagccggatgggacacaagaataacagaggatgatcttcagaatgaggctaaaatcactgacatcatggagcctgaacatgctctattggctacgtcaatttttaagctaacctaccaaaacaaggtggtgagggtgcaaagaccagcaaaaaatggaaccgtgatggatgttatatccagacgtgaccagagaggaagtggacaggtcggaacttatggcttaaatactttcaccaatatggaggtccaactaataagacaaatggagtctgaaggaatctttttacccagcgaactagaaaccactaatctagctgagagagttcttgactggttggaaaaacatggtgtcgaaaggctgaaaagaatggcaattagtggagatgattgtgtggtgaaaccaattgatgacaggttcgcaacagccttaatagctctgaatgacatgggaaaagtaagaaaagacataccgcagtgggaaccctcaaaaggatggaatgactggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatacgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtctggatagaggaaaacccatggatggaggacaaaactcatgtatccagttgggaagaagttccatacctagggaaaagggaagatcaatggtgtggatctctgataggcttgacagcgagggccacctgggccaccaacatacaagtagccataaaccaagtgagaaggctcattgggaatgagaattatctagattacatgacatcaatgaagagattcaagaatgagagtgatcccgaaggggcactctggtaa

SEQ ID NO: 5580 - RNA, 9879 nt, synthetic construct
  misc_feature 1..9879: note = derived and/or modified CDS sequence (wt) from DENV-1__FJ562106__SS-prME
  source 1..9879: mol_type = other RNA
tccgtgaccatgctcctcatgctgctgcccacagccctggctttccatttgaccacacgagggggagagccacacatgatagttagtaagcaggaaagaggaaagtcactcttgttcaagacctctgcaggtgtcaatatgtgcactctcattgcgatggatttgggagaattatgtgaggacacaatgacctacaaatgcccccggatcactgaggcggaaccagatgacgttgactgctggtgcaatgccacagacacatgggtgacctatgggacgtgctctcaaaccggtgaacaccgacgagacaaacgttccgtggcactggccccacacgtgggacttggtctagaaacaagaaccgaaacatggatgtcctctgaaggcgcctggaaacaaatacaaaaagtggagacttgggctttgagacacccaggattcacggtgatagccctttttttagcacatgccataggaacatccatcactcagaaagggatcattttcattttgctgatgctggtaacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaattgtgcattgaagctaaaatatcaaacaccaccaccgattcaagatgtccaacacaaggagaggctacactggtggaagaacaagacgcgaactttgtgtgtcgacgaacgtttgtggacagaggctggggtaatggctgcggactatttggaaaaggaagcctactgacgtgtgctaagttcaagtgtgtgacaaaactggaaggaaagatagttcaatatgaaaacttaaaatattcagtgatagtcactgtccacacaggggaccagcaccaggtgggaaacgagactacagaacatggaacaattgcaaccataacaccccaagctcccacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcaggggcttcaacatcccaagagacttggaacagacaagatttgctggtcacattcaagacagctcatgcaaagaagcaggaagtagtcgtactgggatcacaggaaggagcaatgcacactgcgttgactggggcgacagaaatccagacgtcaggaacgacaacaatctttgcaggacacctgaaatgcagactaaaaatggataaactgactttaaaagggatgtcatatgtgatgtgcacaggctcatttaagctagagaaggaagtggctgagacccagcatggaactgtcctagtgcaggttaaatacgaaggaacagatgcgccatgcaagatccccttttcgacccaagatgagaaaggagtgacccagaatgggagattgataacagccaatcccatagttactgacaaagaaaaaccagtcaacattgagacagaaccaccttttggtgagagctacatcatggtaggggcaggtgaaaaagctttgaaactaagctggttcaagaaaggaagcagcatagggaaaatgttcgaagcaaccgcccgaggagcacgaaggatggctatcctgggagacaccgcatgggacttcggctctataggaggagtgttcacgtctgtgggaaaattggtacaccaggtttttggaaccgcatacggggttctgttcagcggtgtttcttggaccatgaaaataggaatagggatcctgctgacatggttgggattaaattcaaggagcgcgtcgctttcgatgacgtgcattgcagttggcatggttacactgtacctaggagtcatggttcaagcggactcgggatgtgtaatcaactggaagggcagagaactcaaatgtggaagtggcatttttgtcactaatgaagtccacacttggacagagcaatacaaattccaggctgactccccaaaaagactgtcagcagccattgggaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgatcaggccacaacccatggaacacaaatactcatggaaaagctggggaaaagccaaaatcataggagcagacatacagaataccaccttcatcatcgacggcccagatactccagaatgccccgatgaccaaagagcgtggaacatttgggaagttgaggactatgggtttggaattttcacgacaaacatatggctgaaattgcgtgactcctacacccaaatgtgtgaccatcggctaatgtcagctgccatcaagaacagcaaggcagtccatgctgacatggggtactggatagaaagtgaaaagaacgagacctggaagctagcgagagcctccttcatagaagtcaagacatgcatttggccgaaatcccacactctatggagtaatggagttttggaaagtgaaatgataatcccaaagatatatggaggaccaatatctcagcacaattacagaccagggtatttcacacaaacagcagggccatggcacctaggcaagttggaattggattttggcttgtgcgaaggtaccacagttgttgtggatgaacattgtggaaatcgaggtccatctctcagaactacaacagtcacaggaaagataatccatgaatggtgttgcagatcctgcacgttaccccccttacgcttcagaggagaagacggatgttggtatggcatggaaatcagaccagttaaggagaaggaggagaacctagttaggtcaatggtctctgcagggtcaggagaagtggacagtttctcattgggaatactatgcgtatcaataatgattgaagaagtgatgagatccagatggagtagaaagatgctgatgactggaacattggctgttttcctccttcttataatgggacaactgacatggaatgatctgattaggttatgcatcatggttggagctaatgcttctgacaggatggggatgggaacaacgtacctagccttgatggctactttcaaaatgagaccaatgttcgccgttgggttattatttcgcagactaacatccagagaggttcttcttctcacgattggattaagcctggtggcatccgtggagctaccaaattctttggaggaactaggggatggacttgcaatgggtatcatgatgttaaaattattgactgaatttcagccacaccagttatggaccaccttactgtctctgacatttatcaaaacaactttttcattggattatgcatggaagacaatggctatggtactgtcaatcgtatctctctttcctttatgtctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactcctcaaaaatgatgtgccgttagccggcccactaatagctggaggcatgctaatagcatgttatgtcatatccggaagctcagccgatttatcattggagaaagcggctgaggtatcctgggaagaagaagcagaacactctggtacctcacacaacatattagtagaggtccaagatgatggaactatgaaaataaaagatgaagagagggatgacacactcaccatactcctcaaagcaactctgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttgggcaggtcccaagtgggagtgggagttttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaaaaatgtacagacaacgccgggtaccttcaagactcccgaaggcgaagttggagccatagctctagattttaaacccggcacatctggatctcccattgtgaacagagagggaaaaatagtaggtctttatggaaatggagtggtgacaacaagtggaacctacgtcagtgccattgcccaagctaaagcatcacaagaagggcccctaccagagattgaggacgaggtgtttaagaaaagaaacttaacaataatggacctgcatccaggatcaggaaaaacaagaagatatcttccagccatagttcgtgaggccataaaaaggaaactgcgcacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatctccagtgagagttcccaattacaacatgattatcatggatgaagcacattttaccgatccagccagcatagcggccagagggtacatctcaacccgagtaggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgttccaagcattaaatcaggaaatgacattgccaactgtttaagaaagaacggaaaacgggtgatccaattgagcagaaaaacctttgacactgagtaccagaaaacaaaaaacaatgactgggactatgttgtcacaacagacatttccgaaatgggggcaaatttcagggccgacagggtaatagacccaaggcggtgcttgaaaccggtaatactaaaagatggtccagagcgcgtcattctagctggaccgatgccagtgactgtggccagtgctgcccagaggagaggaagaattggaaggaaccaaaacaaggaaggtgatcagtatgtttacatgggacagcctttaaataatgatgaggatcacgcccattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagttgcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccactggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgctatggaggaactaccagacaccatagaaacattgatgctcctagctttgatagctgtgctgactggtggagtgacgctgttcttcctatcaggaaaaggtctagggaaaacatccattggcctgctctgtgtgatggcctcaagcgcactgttatggatggccagtgtggagccccattggatagcggcctccatcatactagagttctttctgatggtgctgctcattccagagccagacagacagcgcactccacaggacaaccagttagcatatgtggtgataggtttgttattcatgatactgacagtggcagccaatgagatgggattattggaaaccacaaagaaagacctggggattggccatgtagccgccgaaaaccaccaccatgctacaatgctggacgtagacctacgtccagcttcagcctggaccctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaactgtagacgggattgttgcaatagacttggatcctgtggtttatgatgcaaaatttgaaaaacagctaggccaaataatgttactgatactttgtacatcacagattctcttgatgcggaccacatgggccttgtgtgaatccatcacactggctacaggacccttgaccactctctgggagggatctccaggaaaattctggaatactacgatagcagtgtccatggcaaacatcttcaggggaagttatctagcaggagcaggtctggccttctcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatctgaagccaaagagggattgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggagcctatcccaatggcgacctatggatggaatctagtaaagctacactctggaaaagatgtattttttacaccacctgagaaatgtgatacccttctgtgtgatattggtgagtcctctccgaatccaactatagaagaaggaagaacgttacgtgttctaaagatggtggaaccatggcttagaggaaaccaattctgcataaaaatcctaaatccttacatgccaagtgtggtagaaactctggagcaaatgcaaagaaaacatggagggatgctagtgagaaacccactctcaagaaattccacccatgaaatgtactgggtttcatgtggaacaggaaacattgtgtcggcagtgaacatgacatccagaatgttactgaatcgattcacaatggctcataggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaagacaatccatacaaaacatgggcctatcatggatcatatgaggtcaagccatcaggatcagcctcatctatggtgaatggcgtggtgagattgctcacaaaaccatgggatgttatccccatggtcacacaaatagctatgactgataccacacccttcggacaacagagagtgtttaaagagaaagttgacacgcgcacaccaagagcaaaacgaggcacagcacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctagagttcgaagcccttggtttcatgaatgaagatcactggttcagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatctttaagctgacctaccaaaacaaggtggtgagggtgcaaagaccagcaaaaaatggaaccgtgatggatgttatatccagacgtgaccagagaggaagtggacaagtcggaacttatggcttaaatactttcaccaatatggaggtccaactaataagacaaatggagtctgaaggaatctttttaccctgcgaattggaaacccccaatctagctgagagagttcttgactggttggaaaaacatggcgccgaaaggctgaaaagaatggcaattagtggagatgattgtgtggtgaaaccaattgatgacaggttcgcaacagccttaatagctctgaatgacatgggaaaagtaagaaaagacataccgcagtgggaaccttcaaaaggatggaatgactggcagcaagtgcctttctgttcacaccatttccaccagctgatcatgaaggatgggagggaaatagtggtgccatgccgcaaccaagatgaacttgtgggtagggctagagtatcacaaggcgccggatggagcctgagagaaactgcttgcctaggcaagtcatacgcacaaatgtggcagctgatgtacttccacaggagagacctgagactagcggctaatgctatctgttcagccgtcccagttgattgggtcccaaccagccgcacaacctggtcaatccatgcccaccaccaatggatgacgacagaagacatgttatcagtgtggaatagggtttggatagaggaaaacccatggatggaggacaaaactcatgtgtccagttgggaagaagttccatacctagggaaaagggaagatcaatggtgcggatctctgataggcttgacaacgagggccacctgggccaccaacatacaagtagccataaaccaagtgagaaggctcatcgggaatgagaattacctagattacatgacatcaatgaagagattcaagaatgagagtgatcccgaaggggcactctggtaa

SEQ ID NO: 5581 - RNA, 9879 nt, synthetic construct
  misc_feature 1..9879: note = derived and/or modified CDS sequence (wt) from DENV-1__FJ410179__SS-prME
  source 1..9879: mol_type = other RNA
tctgtgaccatgctcctcatgctgctgcccacagccctggcgttccatttgaccacacgagggggagagccacacatgatagttagtaagcaggaaagaggaaagtcactgttgtttaagacctctgcaggcatcaatatgtgcactctcattgcgatggatttgggagagttatgcgaggacacaatgacctacaaatgcccccggatcactgaggcggaaccagatgacgttgactgctggtgcaatgccacagacacatgggtgacctatgggacatgttctcaaaccggcgaacaccgacgagacaaacgttccgtggcactggccccacacgtgggacttggtctagaaacaagaaccgaaacatggatgtcctctgaaggtgcctggaaacaaatacaaaaagtggagacttgggctttgagacacccaggattcacggtgacagccctttttttagcacatgccataggaacatccattactcagaaagggatcattttcattttgctgatgctagtaacaccatcaatggccatgcgatgtgtgggaataggcaacagagacttcgttgaaggactgtcaggagcaacgtgggtggacgtggtattggagcatggaagctgcgtcaccaccatggcaaaagataaaccaacattggacattgaactcttgaagacggaggtcacaaaccctgccgtcttgcgcaaactgtgcattgaagctaaaatatcaaacaccaccaccgattcaaggtgtccaacacaaggagaggccacactggtggaagaacaagactcgaactttgtgtgtcgacgaacgtttgtggacagaggctggggtaatggctgcggactatttggaaaaggaagcctactgacgtgtgctaagttcaagtgtgtgacaaaactagaaggaaagatagttcaatatgaaaacttaaaatattcagtgatagtcactgtccacactggggaccagcaccaggtgggaaacgagactacagaacatggaacaattgcaactataacacctcaagctcctacgtcggaaatacagctgactgactacggagccctcacattggactgctcacctagaacagggctggactttaatgagatggttctattgacaatgaaagaaaaatcatggcttgtccacaaacaatggtttctagacttaccactgccttggacttcaggagcttcaacatctcaagagacttggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacacctgaaatgcagactaaaaatggataaactgactttaaaagggatgtcatatgtaatgtgcacaggctcatttaagctagagaaggaagtggctgagacccagcatggaactgttctagtgcaggttaaatacgaaggaacagatgcgccatgcaagatccctttttcggcccaagatgagaaaggagtgacccagaatgggagattgataacagccaaccccatagtcactgacaaagaaaaaccagtcaacattgagacagaaccaccttttggtgagagctacatcgtggtaggggcaggtgaaaaagctttgaaactgagctggttcaagaaagggagcagcatagggaaaatgttcgaagcaactgcccgaggagcacgaaggatggctatcctgggagacaccgcatgggactttggctctataggaggagtgttcacatcagtgggaaaattggtacaccaggtttttggagccgcatatggggttctgttcagcggtgtttcttggaccatgaaaataggaatagggattctgctgacatggttgggattaaattcaaggagcacgtcactttcgatgacgtgcattgcggttggcatggtcacactgtacctaggagtcatggttcaagcggactcgggatgtgtaatcaactggaagggcagagaactcaaatgtggaagtggtatttttgtcactaatgaagtccacacttggacagagcaatacaaattccaggctgactccccaaaaagactgtcagcagccattgggaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgattaggccacaacccatggaacatagatactcatggaaaagctggggaaaagccaaaatcataggagcagacatacagaatagcaccttcatcatcgacggcccagatactccagaatgccccgatgaccaaagagcgtggaacatttgggaagttgaagactatgggtttggaattttcacgacaaacatatggctgaaattgcgcgactcctacacccaaatgtgtgaccaccggctaatgtccgctgccatcaaagacagcaaggcagtccatgctgacatggggtactggatagaaagtgaaaagaacgagacctggaagctagcgagagcctccttcatagaagtcaagacatgtatctggccgaaatcccacactctatggagtaatggagttttggaaagtgaaatgataatcccaaagatgtatggaggaccaatatctcagcacaactacagaccagggtatttcacacaaacagcagggccatggcacctaggcaagttggaattggattttgacttgtgtgaaggtaccacagttgttgtggatgaacattgtggaaatcgaggcccatctctcagaactacaacagtcacaggaaagataatccatgaatggtgttgcagatcctgcacgttaccccccttacgcttcagaggagaagacggatgttggtatggcatggaaatcagaccagttaaggagaaggaggaaaacctagttaggtcaatggtctctgcagggtcaggagaagtggacagtttttcactagggatactatgcgtatcaataatgattgaagaagtgatgagatccagatggagtagaaagatgctgatgactggaacattggctgttttcctccttcttataatgggacaactgacatggaatgacctgattaggttatgcatcatggttggagctaatgcttcagacaggatggggatgggaacaacgtacctggccttgatggctactttcaaaatgagaccaatgttcgctgttgggctactatttcgcagactaacatccagagaagttcttcttctcacgattggattaagcctggtggcatccgtggagttaccaaattctttggaggagctaggggatggacttgcaatgggtatcatgatgttaaaattattgactgaatttcagccacaccagttatggaccaccttactgtctttgacatttatcaaaacaactctttcattggattatgcatggaggacaatggctatggtgctgtcaatcgtatctctctttcctttatgtctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactccttaaaaatgatgtgccgttggccggcccactaatagctggaggcatgctaatagcatgttatgtcatatccggaagctcagccgatttatcattggagaaagcggctgaggtatcctgggaagaagaagcagaacactctggtacctcacacaacatattagtagaggtccaagatgatggaactatgaaaataaaagatgaagagagggatgacacactcaccatactcctcaaagcaactctgctggcaatctcaggagtgtacccaatgtcaataccagcaactcttttcgtgtggtatttttggcagaaaaagaaacagagatcaggagtgttatgggacacacccagccctccggaagtggaaagagcagttcttgatgatggcatctatagaatcctgcaaagaggactgttgggcaggtcccaagtgggagtgggagttttccaagacggcgtgttccacacaatgtggcacgtcaccaggggagctgtccttatgtaccaagggaagaggttggaaccaagctgggccagtgtcaaaaaggacttgatctcatatggaggaggttggagatttcaaggatcatggaacacgggagaagaggtgcaggtgatagccgttgaaccaggaaaaaatcctaaaaatgtacagacaacgccgggtaccttcaagactcccgaaggcgaagttggagccatagctctagattttaaacccggcacatctggatctcccatcgtgaacagagagggaaaaatagtaggtctttatggaaatggagtggtgacaacaagtggaacctacgtcagtgccattgcccaagctaaaacatcacaagaagggcctctaccagagattgaggaggaggtgtttaagaaaaggaacttaacaataatggacctgcatccaggatcgggaaaaacaagaagatatcttccagccatagtccgtgaggccataaaaaggaaactgcgcacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatctccagtgagagttcccaattacaacatgattatcatggatgaagcacattttaccgatccagccagcatagcggccagagggtacatctcaactcgagtgggtatgggtgaagcagctgcgatctttatgacagccactcccccaggatcggtggaggcctttccacaaagcaatgcagttatccaagatgaggaaagagacattcctgagagatcatggaactcaggctacgactggatcactgattttccaggtaaaacagtctggtttgttccaagcattaagtcaggaaatgacattgctaactgtttaagaaagaacggaaaacgggtgatccaattgagcagaaaaacctttgacactgagtaccagaaaacaagaaacaatgactgggactatgttgtcacaacagacatttccgaaatgggggcaaatttccgggccgacagggtaatagacccaaggcggtgcttgaaaccagtgatactaaaagatggtccagagcgtgtcattctagccggaccgatgccagtgactgtggccagtgctgcccagagaagaggaagaattggaaggaaccaaaacaaggaaggtgatcagtacgtttatatgggacagcctttaaataatgatgaggatcacgctcattggacagaagcaaaaatgctccttgacaatataaacacaccagaagggatcattccagccctctttgagccagagagagaaaagagtgcagcaatagatggggagtacagactgcggggagaagcaaggaaaacgttcgtggagctcatgagaagaggagatctaccagtttggctatcctacaaagttgcctcagaaggtttccagtactccgacagaaggtggtgctttgacggggaaaggaacaaccaggtgttggaggagaacatggacgtggagatctggacaaaggaaggagaaaggaagaaattgcgaccccgctggttggatgccagaacatactctgatccactggcccttcgtgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgctatggaggaactaccagacaccatagaaacactgatgctcctagctttgatagctgtgctgactggtggagtgacgctgttcttcctatcaggaaaaggtctagggaaaacatccattggcctgctctgtgtgatggcctcaagcgcactgttatggatggccaatgtggagccacattggatagcggcctccatcatactagagttctttctgatggtgctgctcattccagagccagacagacagcgcactccacaggacaaccagctagcatacgtggtgataggtttgttattcatgatactgacagtggcagccaatgagatgggattattggaaaccacaaagaaagacctggggattggccatgtagccgccgaaaaccaacaccatgccacgatgctggacgtagacctacgcccagcttcagcctggaccctctatgcagtagccacaacagttatcactcccatgatgagacacacaattgaaaacacaacagcaaacatttccctgacagccattgcaaaccaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagttaggccaaataatgttactgatactttgtacatcacagattctcttgatgcggaccacatgggccctgtgtgaatccatcacactggctactggacccttgaccactctctgggagggatctccaggaaaattctggaataccacgatagcagtgtccatggcaaacatcttcaggggaagttatctagcaggagcaggtctggccttctcgttaatgaaatctttgggaggaggcaggagaggtacgggggctcaaggagaaacactgggagagaaatggaaaagacagttaaaccaactgagcaagtcagaattcaacacctacaaaaggagtgggattatggaggtggacagatccgaagccaaagagggattgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtcaagggatacacaaaaggaggacctggacatgaggaacctatcccaatggcgacctatggatggaacctagtaaagctatactctggaaaagatgtattttttacaccacctgagaaatgtgatacccttctgtgtgatataggagagtcctctccgaatccaactatagaagaaggaagaacgttacgtgttctaaagatggtagaaccatggctcagaggaaaccaattctgcataaaaattctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatgactcacaggaagccaacatatgaaagagacgtggacttaggcgctggaacaagacatgtggcagtggaaccagaggtagccaacctagatattattggccagaggatagagaatataaaaaatgaacataagtcaacatggcattatgatgaagacaatccatacaaaacatgggcctatcatggatcatatgaggtcaaaccatcaggatcagcctcatctatggtgaatggcgtggtgagattgctcacaaaaccatgggatgtcatccccatggtcacacaaatagccatgaccgataccacacccttcggacaacagagagtgtttaaagagaaagtagatacgcgcacgccgagagcaaaacgaggcacagcacaaattatggaggtgacagccaagtggctatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggaacttcataaacagggaaaatgtgccacgtgtgtctacaacatgatggggaagagagagaaaaaattgggagagtttggaaaggcaaaaggaagtcgtgcaatatggtacatgtggctgggagcacgctttctagagttcgaagcccttggtttcatgaatgaagatcactggttcagtagagagaattcattcagtggagtggaaggagaaggactgcacaaacttggatacatactcagagacatatcaaagatcccggggggaaacatgtatgcagatgacacagccggatgggacacaagaataacagaggatgatcttcagaatgaggctaaaatcactgacatcatggagcctgaacacgctctattggctacgtcaatttttaagctgacctaccaaaacaaggtggtaagggtgcaaagaccagcaaaaaatggaaccgtgatggatgttatatccagacgagaccagagaggaagtgggcaggtcggaacctatggcttaaatactttcaccaatatggaggtccaactaataagacaaatggagtctgaaggaatctttttacccagcgaattggaaacccccaatctagctgagagagttcttgactggttggaaaaacatggcactgaaagactgaaaagaatggcaattagcggagatgattgtgtggtgaaaccagttgatgacaggtttgcaacagccttaatagctctgaatgacatgggaaaagtaagaaaagacataccgcagtgggaaccttcaaaaggatggaatgactggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctaagactagcggctaatgctatctgttcagctgtcccagttgactgggtcccaaccagtcgcacaacctggtcaatccatgctcaccatcaatggatgacaacagaagacatgttatcagtgtggaatagggtttggatagaggaaaacccatggatggaggataaaactcatgtatccagctgggaagaagtcccatacttagggaaaagggaagatcaatggtgtggatccctgataggcttgacagcgagggccacttgggccactaacatacaagtagccataaaccaagtgagaaggctcatcgggaatgagaattatctagattacatgacatcaatgaagagattcaagaatgagagtgatcccgaaggggcactctggtaa

SEQ ID NO: 5582 - RNA, 9879 nt, synthetic construct
  misc_feature 1..9879: note = derived and/or modified CDS sequence (wt) from DENV-1__FJ410181__SS-prME
  source 1..9879: mol_type = other RNA
tctgtgaccatgctcctcatgctgctgcccacagccctggcgttccatttgaccacacgagggggagagccacacatgatagttagtaagcaggaaagaggaaagtcactgttgtttaagacctctgtaggcatcaatatgtgcactctcattgcgatggatttgggagagttatgcgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggacttggtctagaaacaagaaccgaaacatggatgtcctctgaaggtgcctggaaacaaatacaaaaagtggagacttgggctttgagacacccaggattcacggtgacagccctttttttagcacatgccataggaacatccattactcagaaagggatcattttcattttgctgatgctagtaacaccatcaatggccatgcgatgtgtgggaataggcaacagagacttcgttgaaggactgtcaggagcaacgtgggtggacgtggtattggagcatggaagctgcgtcaccaccatggcaaaagataaaccaacattggacattgaactcttgaagacggaggtcacaaaccctgccgtcttgcgcaaactgtgcattgaagctaaaatatcaaacaccaccaccgattcaaggtgtccaacacaaggagaggctacactggtggaagaacaagactcgaactttgtgtgtcgacgaacgtttgtggacagaggctggggtaatggctgcggactatttggaaaaggaagcctactgacgtgtgctaagttcaagtgtgtgacaaaactagaaggaaagatagttcaatatgaaaacttaaaatattcagtgatagtcactgtccacactggggaccagcaccaggtgggaaacgagactacagaacatggaacaattgcaaccataacacctcaagctcctacgtcggaaatacagctgactgactacggagccctcacattggactgctcgcctagaacagggctggactttaatgagatggttctattgacaatgaaagaaaaatcatggcttgtccacaaacaatggtttctagacttaccactgccttggacttcaggagcttcaacatctcaagagacttggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcgggacacctgaaatgcagactaaaaatggataaactgactttaaaggggatgtcatatgtaatgtgcacaggctcatttaagctagagaaggaagtggctgagacccagcatggaactgttctagtgcaggttaaatacgaaggaacagatgcgccatgcaagatccctttttcggcccaagatgagaaaggagtgacccagaatgggagattgataacagccaaccccatagtcactgacaaagaaaaaccagtcaacattgagacagaaccaccttttggtgagagctacatcgtgataggggcaggtgaaaaagctttgaaactgagctggttcaagaaagggagcagcatagggaaaatgttcgaagcaactgcccgaggagcacgaaggatggctatcctgggagacaccgcatgggactttggctctataggaggagtgttcacatcagtgggaaaattggtacaccaggtttttggagccgcatatggggttctgttcagcggtgtttcttggaccatgaaaataggaatagggattctgctgacatggttgggattaaattcaaggagcacgtcactttcgatgacgtgcattgcggttggcatggtcacactgtacctaggagtcatggttcaagcggactcgggatgtgtaatcaactggaagggcagagaactcaaatgtggaagtggtatttttgtcactaatgaagtccacacttggacagagcaatacaaattccaggctgactccccaaaaagactgtcagcagccattgggaaggcatgggaggagggcgtgtgtggaattcgatcagccacgcgtcttgagaacatcatgtggaagcaaatatcaaatgaattgaaccatattctacttgaaaatgacatgaaattcacagtggttgtaggagatgctaatggaattttggcccaagggaaaaaaatgattaggccacaacccatggaacatagatactcatggaaaagctggggaaaagccaaaatcataggagcagacatacagaataccaccttcatcatcgacggcccagatactccagaatgccccgatgaccaaagagcgtggaacatttgggaagttgaagactatgggtttggaattttcacgacaaacatatggctgaaattgcgcgactcctacacccaaatgtgtgaccaccggctaatgtcagctgccatcaaagacagcaaggcagtccatgctgacatggggtactggatagaaagtgaaaagaacgagacctggaagctagcgagagcctccttcatagaagtcaagacatgtatctggccgaaatcccacactctatggagtaatggagttttggaaagtgaaatgataatcccaaagatatatggaggaccaatatctcagcacaactacagaccagggtatttcacacaaacagcagggccatggcacctaggcaagctggaattggattttgacttgtgtgaaggtaccacagttgttgtggatgaacattgtggaaatcgaggtccatctctcagaactacaacagtcacaggaaagataatccatgaatggtgttgcagatcctgcacgttaccccccttacgcttcagaggagaagacggatgttggtatggcatggaaatcagaccagttaaggagaaggaggaaaacctagttaggtcaatggtctctgcagggtcaggagaagtagacagtttttcactagggatactatgcgtatcaataatgattgaagaagtgatgagatccagatggagtagaaagatgctgatgactggaacattggctgttttcctccttcttataatgggacaactgacatggaatgatctgattaggttatgcatcatggttggagctaatgcttcagacaggatggggatgggaacaacgtacctggccttgatggctactttcaaaatgagaccaatgttcgctgttgggctattatttcgcagactaacatccagagaagttcttcttctcacgattggattgagcctagtggcatccgtggagttaccaaattctttggaggagctaggggatggacttgcaatgggtatcatgatgttaaaattattgactgaatttcagccacaccagttatggaccaccttactgtctttgacatttatcaaaacaactctttcattggattatgcatggaggacaatggctatggtgctgtcaatcgtatctctctttcctttatgtctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactccttaaaaatgatgtgccgttagccggcccactaatagctggaggcatgctaatagcatgttatgtcatatctggaagctcagccgatttatcattggagaaagcggctgaggtatcctgggaagaagaagcagaacactctggtacctcacacaacatattagtagaggtccaagatgatggaactatgaaaataaaagatgaagagagggatgacacactcaccatactcctcaaagcaactctgctggcagtctcaggagtgtacccaatgtcaataccagcaactcttttcgtgtggtacttttggcagaaaaagaaacagagatcaggagtgttatgggacacacccagccctccggaagtggaaagagcagttcttgatgatggcatctatagaatcctgcaaagaggactgttgggcaggtcccaagtaggagtgggagtcttccaagacggcgtgttccacacaatgtggcacgtcaccaggggagctgtccttatgtaccaagggaagaggttggaaccaagctgggccagtgtcaaaaaggacttgatctcatatggaggaggttggagatttcaaggatcatggaacacgggagaagaggtgcaggtgatagctgttgaaccaggaaaaaatcccaaaaatgtacagacaacgccgggtaccttcaagactcccgaaggcgaagttggagccatagctctagattttaaacccggcacatctggatctcccatcgtgaacagagagggaaaaatagtaggtctttatggaaatggagtggtgacaacaagtggaacctacgtcagtgccattgcccaagctaaaacatcacaagaagggcctctaccagagattgaggacgaggtgtttaagaaaaggaacttaacaataatggacctgcatccaggatcgggaaaaacaagaagatatcttccagccatagtccgtgaggccataaaaaggaaactgcgcacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatctccagtgagagttcccaattacaacatgattatcatggatgaagcacattttaccgatccagccagcatagcggccagagggtacatctcaactcgagtgggtatgggtgaagcagctgcgatctttatgacagccactcccccaggatcggtggaggcctttccacaaagcaatgcagttatccaagatgaggaaagagacattcctgagagatcatggaactcaggctacgactggatcactgattttccaggtaaaacagtctggtttgttccaagcattaagtcaggaaatgacattgctaactgcttaagaaagaacggaaaacgggtgatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccagtgatactaaaagatggtccagagcgtgtcattctagccggaccgatgccagtgactgtggccagtgctgcccagagaagaggaagaattggaaggaaccaaaacaaggaaggtgatcagtacgtttatatgggacagcctttaaataatgatgaggatcacgctcattggacagaagcaaaaatgctccttgacaatataaacacaccagaagggatcattccagccctctttgagccagagagagaaaagagtgcagcaattgatggggagtacagactgcggggagaagcaaggaaaacgttcgtggagctcatgagaagaggagatctaccagtttggctatcctacaaagttgcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccactggcccttcgtgagttcaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgctatggaggaactaccagacaccatagaaacattgatgctcctagctttgatagctgtgctgactggtggagtgacgctgttcttcctatcaggaaaaggtctagggaaaacatccattggcctgctctgtgtgatggcctcaagcgcactgttatggatggccaatgtggagccacattggatagcggcctccatcatactagagttctttctgatggtgctgctcattccagagccagacagacagcgcactccacaggacaaccagctagcatacgtggtgataggtttgttattcatgatactgacagtggcagccaatgagatgggattattggaaaccacaaagaaagacctggggattggccatgtagccgccgaaaaccaacaccatgccacgatgctggacgtagacctacgcccagcttcagcctggaccctctatgcagtagccacaacagttatcactcctatgatgagacacacaattgaaaacacaacggcaaacatttccctgacagccattgcaaaccaggcagctatattgatgggacttgacaagggatggccaatatcgaagatggacataggagttccacttctcgccttagggtgctattcccaagtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagttaggccaaataatgttactgatactttgtacatcacagattctcttgatgcggaccacatgggccttgtgtgaatccatcacactggctactggacccttgaccactctctgggagggatctccaggaaaattttggaataccacgatagcagtgtccatggcaaacatcttcaggggaagttatctagcaggagcaggtctggccttctcgttaatgaaatctttgggaggaggcaggagaggtacgggggctcaaggagaaacactgggagagaaatggaaaagacagttaaaccaactgagcaagtcagaattcaacacctacaaaaggagtgggattatggaggtggacagatccgaagccaaagagggattgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtcaagggatacacaaaaggaggacctggacatgaggaacctatcccaatggcgacctatggatggaacctagtaaagctatactctggaaaagatgtattttttacaccacctgagaaatgtgatacccttctgtgtgacataggagagtcctctccgaatccaactatagaagaaggaagaacgttacgtgttctaaagatggtagaaccatggctcagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactaaatcgattcacaatggctcacaggaagccaacatatgaaagagacgtggacttaggcgctggaacaagacatgtggcagtggaacctgaggtagccaacctagatatcattggccagaggatagagaatataaaaaatgaacacaagtcaacatggcattatgatgaagacaatccatacaaaacatgggcctatcatggatcatatgaggtcaaaccatcaggatcagcctcatctatggtgaatggcgtggtgagattgctcacaaaaccatgggatgtcatccccatggtcacacaaatagccatgaccgataccacacccttcggacaacagagagtgtttaaagagaaagtggacacgcgcacaccaagagcaaaacgaggcacagcacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgtacagagagagggagcttcataaacagggaaaatgtgccacgtgtgtctacaacatgatggggaagagagagaaaaaattgggagagtttggaaaggcaaaaggaagtcgtgcaatatggtacatgtggctgggagcacgctttctagagttcgaagcccttggtttcatgaatgaagatcactggttcagtagagagaattcattcagtggagtggaaggagaaggactgcacaaacttggatacatactcagagacatatcaaagatcccggggggaaatatgtatgcagatgacacagccggatgggacacaagaataacagaggatgatcttcagaatgaggctaaaatcactgacatcatggagcctgaacacgctctattggctacgtcgatttttaagctgacctaccaaaacaaggtggtaagggtgcaaagaccagcaaaaaatggaaccgtgatggatgttatatccagacgagatcagagaggaagtgggcaggtcggaacctatggcttaaatactttcaccaatatggaggtccaactaataagacaaatggagtctgaaggaatctttttacccagcgaactggaaacccccaatctagctgagagagttcttgactggttggaaaaacatggcaccgaaaggctgaaaagaatggcaattagcggagatgattgtgtggtgaaaccggttgatgacaggtttgcaacagccttaatagctctgaatgacatgggaaaagtaagaaaagacataccgcagtgggaaccttcaaaaggatggaatgactggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatacgcacaaatgtggcagctgatgtacttccacaggagagacctaagactagcggctaatgctatctgttcagctgtcccagttgactgggtcccaaccagccgcacaacctggtcaatccatgctcaccatcaatggatgacaacagaagatatgttatcagtgtggaatagggtttggatagaggaaaacccatggatggaggataaaactcacgtgtccagctgggaagaagtcccatacttagggaaaagggaagatcaatggtgtggatccctgataggcttgacagcgagggccacttgggccactaacatacaagtagccataaaccaagtgagaaggctcatcgggaacgagaattatctagattacatgacatcaatgaagagattcaagaatgagagtgatcccgaaggggcactctggtaa

SEQ ID NO: 5583 - RNA, 9879 nt, synthetic construct
  misc_feature 1..9879: note = derived and/or modified CDS sequence (wt) from DENV-1__FJ547086__SS-prME
  source 1..9879: mol_type = other RNA
tccgtgaccatgctccttatgctgctgcccacagccctggctttccatttgaccacacgagggggagagccacacatgatagttagtaagcaggaaagaggaaagtcactcttgttcaagacctctgcaggtgtcaatatgtgcactctcattgcgatggatttgggagaattatgtgaggacacaatgacctacaaatgcccccggatcactgaggcggaaccagatgacgttgactgctggtgcaatgccacagacacatgggtgacctatgggacgtgctctcaaaccggtgaacaccgacgagacaaacgttccgtggcactggccccacacgtgggacttggtctagaaacaagaaccgaaacatggatgtcctctgaaggcgcctggaaacaaatacaaaaagtggagacttgggctttgagacacccaggattcacggtgatagccttttttttagcacatgccataggaacatccatcactcagaaagggatcattttcattttgctgatgctggtaacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaattgtgcattgaagctaaaatatcaaacaccaccaccgattcaagatgtccaacacaaggagaggcgacactggtggaagaacaagacgcgaactttgtgtgtcgacgaacgtttgtggacagaggctggggtaatggctgcggactatttggaaaaggaagcctactgacgtgtgctaagttcaagtgtgtgacaaaactggaaggaaagatagttcaatatgaaaacttaaaatattcagtgatagtcactgtccacacaggggaccagcaccaggtgggaaacgagactacagaacatggaacaattgcaaccataacaccccaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacttggaacagacaagatttgttggtcacattcaagacagctcatgcaaagaagcaggaagtagtcgtactgggatcacaggaaggagcaatgcacactgcgttgactggggcgacagaaatccagacgtcaggaacgacaacaatctttgcaggacacctgaaatgtagactaaaaatggataaactgactttaaaagggatgtcatatgtgatgtgcacaggctcatttaagctagagaaggaagtggctgagacccagcatggaactgtcctagtgcaggttaaatacgaaggaacagatgcgccatgcaagatccccttttcgacccaagatgagaaaggagtgacccagaatgggagattgataacagccaatcccatagttactgacaaagaaaaaccagtcaacattgagacagaaccaccttttggtgagagctacatcatggtaggggcaggtgaaaaagctttgaaactaagctggttcaagaaaggaagcagcatagggaaaatgttcgaagcaaccgcccgaggagcacgaaggatggctatcctgggagacaccgcatgggacttcggctctataggaggagtgttcacgtctgtgggaaagttggtacaccaggtttttggaaccgcatacggggttctgttcagcggtgtttcttggaccatgaaaataggaatagggatcctgctgacatggttgggattaaattcaaggagcgcgtcgctttcgatgacgtgcattgcagttggtatggttacactgtacctaggagtcatggttcaagcggactcgggatgtgcaatcaactggaagggcagagaactcaaatgtggaagtggcatttttgtcactaatgaagtccacacttggacagagcaatacaaattccaggctgactccccaaaaagactgtcagcagccattgggaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgatcaggccacaacccatggaacacaaatactcatggaaaagctggggaaaggccaaaatcataggagcagacatacagaataccaccttcatcatcgacggcccagatactccagaatgccccgatgaccaaagagcgtggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacctggaagctagcgagagcctccttcatagaagtcaagacatgcatttggccgaaatcccacactctatggagtaatggagttttggaaagtgaaatgataatcccaaagatatatggaggaccaatatctcagcacaattacagaccagggtatttcacacaaacagcagggccatggcacctaggcaagttggaattggattttgacttgtgtgaaggtaccacagttgttgtggatgaacattgtggaaatcgaggtccatctctcagaactacaacagtcacaggaaagataatccatgaatggtgttgcagatcctgcacgttaccccccttacgcttcagaggagaagacggatgttggtatggcatggaaatcagaccagttaaggagaaggaggagaacctagttaggtcaatggtctctgcagggtcaggagaagtggacagtttttcattgggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttctgacaggatggggatgggaacaacgtacctagccttgatggctactttcaaaatgagaccaatgttcgccgttgggttattatttcgcagactaacatccagagaggttcttcttctcacgattggattaagcctggtggcatccgtggagctaccaaattctttggaggaactaggggatggacttgcaatgggtatcatgatgttaaaattactgactgaatttcagccacaccagttatggaccaccttactgtctctgacatttatcaaaacaactctttcattggattatgcatggaagacaatggctatggtactgtcaatcgtatctctctttcctttatgtctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactcctcaaaaatgatgtgccgttagccggcccactaatagctggaggcatgctaatagcatgttatgtcatatccggaagctcagccgatttatcattggagaaagcggctgaggtatcctgggaagaagaagcagaacactctggtacctcacacaacatattagtagaggtccaagatgatggaactatgaaaataaaagatgaagagagggatgacacactcaccatactcctcaaagcaactctgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttgggcaggtcccaagtgggagtgggagttttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaaaaatgtacagacaacgccgggtaccttcaagactcccgaaggcgaagttggagccatagctctagattttaaacccggcacatctggatctcccattgtgaacagagagggaaaaatagtaggtctttatggaaatggagtggtgacaacaagtggaacttacgtcagtgccattgcccaagctaaagcatcacaacaagggcccctaccagagattgaggacgaggtgtttaagaaaagaaacttaacaataatggacctgcatccaggatcaggaaaaacaagaagatatcttccagccatagttcgtgaggccataaaaaggaaactgcgcacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatctccagtgagagttcccaattacaacatgattatcatggatgaagcacattttaccgatccagccagcatagcggccagagggtacatctcaacccgagtaggtatgggtgaagcagctgcgatctttatgacagcaactcccccaggatcggtggaggcctttccacagagcaatgcagttatccaagatgaggaaagagacattcctgagagatcatggaactcaggctacgactggatcactgattttccaggtaaaacagtctggtttgttccaagcattaaatcaggaaatgacattgccaactgtttaagaaagaacggaaaacgggtgatccaattgagcagaaaaacctttgacactgagtaccagaaaacaaaaaacaatgactgggactatgttgtcacaacagacatttccgaaatgggggcaaatttcagggccgacagggtaatagacccaaggcggtgcttgaaaccggtaatactaaaagatggtccagagcgcgtcattctagctggaccgatgccagtgactgtggccagtgctgcccagaggagaggaagaattggaaggaaccaaaacaaggaaggtgatcagtatgtttacatgggacagcctttaaataatgatgaggatcacgcccattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagttgcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccactggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgctatggaggaactaccagacaccatagaaacattgatgctcctagctttgatagctgtactgactggtggagtgacgctgttcttcctatcaggaaaaggtctagggaaaacatccattggcctgctctgtgtgatggcctcaagcgcactgttatggatggccagtgtggagccccattggatagcggcctccatcatactagagttctttctgatggtgctgctcattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccatcatgctacaatgctggacgtagacctacgtccagcttcagcctggaccctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaactgtagacgggattgttgcaatagacttggatcctgtggtttatgatgcaaaatttgaaaaacagctaggccaaataatgttactgatactttgtacatcacagattctcttgatgcggaccacatgggccttgtgtgaatccatcacactggctacaggacccttgaccactctctgggagggatctccaggaaaattctggaatactacgatagcagtgtccatggcaaacatcttcaggggaagttatctagcaggagcaggtctggccttctcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatctgaagccaaagagggattgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttacaccacctgagaaatgtgatacccttctgtgtgatattggtgagtcctctccgaatccaactatagaagaaggaagaacgttacgtgttctaaagatggtggaaccatggcttagaggaaaccaattctgcataaaaatcctaaatccttacatgccaagtgtggtagaaactctggagcaaatgcaaagaaaacatggagggatgctagtgagaaacccactctcaagaaattccacccatgaaatgtactgggtttcatgtggaacaggaaacattgtgtcggcagtgaatatgacatccagaatgttactgaatcgattcacaatggctcataggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaagacaacccatacaaaacatgggcctatcatggatcatatgaggtcaagccatcaggatcagcctcatctatggtgaatggcgtggtgagattgctcacaaaaccatgggatgttatccccatggtcacacaaatagctatgactgataccacacccttcggacaacagagagtgtttaaagagaaagttgacacgcgcacaccaagagcaaaacgaggcacagcacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgcgccacgtgtgtctacaacatgatggggaagagagagaaaaaattaggagagtttggaaaggcaaaaggaagtcgtgcaatatggtacatgtggctgggagcacgctttctagagttcgaagcccttggtttcatgaatgaagatcactggttcagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacctaccaaaacaaagtggtgagggtgcaaagaccagcaaaaaatggaaccgtgatggatgttatatccagacgtgaccagagaggaagtggacaagtcggaacttatggcttaaatactttcaccaatatggaggtccaactaataagacaaatggagtctgaaggaatctttttaccctgcgaattggaaacccccaatctagctgagagagttcttgactggttggaaaaacatggcgccgaaaggctgaaaagaatggcaattagtggagatgattgtgtggtgaaaccaattgatgacaggttcgcaacagccttaatagctctgaatgacatgggaaaagtaagaaaagacataccgcagtgggaaccttcaaaaggatggaatgactggcagcaagtgcctttctgttcacaccatttccaccagctgatcatgaaggatgggagggaaatagtggtgccatgccgcaaccaagatgaacttgtgggtagggctagagtatcacaaggcgccggatggagcctgagagaaactgcttgcctaggcaagtcatacgcacaaatgtggcagctgatgtacttccacaggagagacctgagactagcggctaatgctatctgttcagccgtcccagttgattgggtcccaaccagccgcacaacctggtcaatccatgcccaccaccaatggatgacgacagaagacatgttatcagtgtggaatagggtttggatagaggaaaacccatggatggaggacaaaactcatgtatccagttgggaagaagttccatacctagggaaaagggaagatcaatggtgtggatctctgataggcttgacagcgagggccacctgggccaccaacatacaagtagccataaaccaagtgagaaggctcatcgggaatgagaattacctagattacatgacatcaatgaagagattcaagaatgagagtaatcccgaaggggcactctggtaa

SEQ ID NO: 5584 - RNA, 9879 nt, synthetic construct
  misc_feature 1..9879: note = derived and/or modified CDS sequence (wt) from DENV-1__FJ410183__SS-prME
  source 1..9879: mol_type = other RNA
tctgtgaccatgctcctcatgctgctgcccacagccctggcgttccatttgaccacacgagggggagagccacacatgatagtcagtaagcaggaaagaggaaagtcactgttgttcaagacctctgcaggcatcaacatgtgcactctcattgcgatggatttgggagagttatgcgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggacttggtctagagacaagaaccgaaacatggatgtcctctgaaggtgcctggaaacaaatacaaaaagtggagacttgggctttgagacacccaggattcacggtgacagccttttttttagcacatgccataggaacatccattactcagaaagggatcattttcattttgctgatgctagtaacaccatcaatggccatgcgatgtgtgggaataggcaacagagacttcgttgaaggactgtcaggagcaacgtgggtggacgtggtattggagcatggaagctgcgtcaccaccatggcaaaagataaaccaacattggacattgaactcttgaagacggaggtcacaaaccctgccgtcttgcgcaaactgtgcattgaagctaaaatatcaaacaccaccaccgattcaaggtgtccaacacaaggagaggctacactggtggaagaacaagactcgaactttgtgtgtcgacgaacgtttgtggacagaggctggggtaatggctgcggactatttggaaaaggaagcctactgacgtgtgctaagttcaagtgtgtgacaaaactggaaggaaagatagttcaatatgaaaacttaaaatattcagtgatagtcactgtccacactggggaccagcaccaggtgggaaacgagactacagaacatggaacaattgcaaccataacacctcaagctcctacgtcggaaatacagctgactgactacggagctctcacattggactgctcgcctagaacagggctggactttaatgagatggtgctattgacaatgaaagaaaaatcatggcttgtccacaaacaatggtttctagacttaccactgccttggacttcaggagcttcaacatctcaagagacttggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacacctgaaatgcagactaaaaatggataaactgactttaaaagggatgtcatatgtgatgtgcacaggctcatttaagctagagaaggaagtggctgagacccagcatggaactgttctagtgcaggttaaatacgaaggaacagatgcgccatgcaagatccctttttcggcccaagatgagaaaggagtgacccagaatgggagattgataacagccaaccccatagtcactgacaaagaaaaaccagtcaacattgagacagaaccaccttttggtgagagctacatcgtggtaggggcaggtgaaaaagctttgaaactgagttggttcaagaaagggagtagcatagggaaaatgttcgaagcaactgcccgaggagcacgaaggatggctatcctgggagacaccgcatgggactttggctctataggaggagtgttcacatcagtgggaaaattggtacaccaggtctttggagccgcatatggggttctattcagcggtgtttcttggaccatgaaaataggaatagggattctgctgacatggttgggattaaattcaaggagcacgtcactttcgatgacgtgcattgcggttggcatggtcacactgtacctaggagtcatggttcaagcggactcgggatgtgtaatcaactggaagggcagagaactcaaatgtggaagtggtatttttgtcactaatgaagtccacacttggacagagcaatacaaattccaggctgactccccaaaaagactgtcagcagccattgggaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgatcaggccacaacccatggaacatagatactcatggaaaagctggggaaaagccaaaatcataggagcagacatacagaataccaccttcatcatcgacggcccagatactccagaatgccccgatgaccaaagagcgtggaacatttgggaagttgaagactatgggtttggaattttcacgacaaacatatggctaaaattgcgcgactcctacacccaaatgtgtgaccaccggctaatgtcagctgccatcaaagacagcaaggcagtccatgctgacatggggtactggatagaaagtgaaaagaacgagacctggaagctggcgagagcctccttcatagaagtcaagacatgtatctggccgaaatcccacactctatggagcaatggagttttggaaagtgaaatgataatcccaaagatgtatggaggaccaacatctcagcacaactacagaccagggtatttcacacaaacagcagggccatggcacctaggcaagttggaattggattttgacttgtgtgaaggtaccacagttgttgtggatgaacattgtggaaatcgaggtccatctctcagaactacaacagtcacaggaaagataatccatgaatggtgttgcagatcctgcacgttaccccccttacgcttcagaggagaagacggatgttggtatggcatggaaatcagaccagttaaggagaaggaggaaaacctagttaggtcaatggtctctgcagggtcaggagaaatggacagtttttcactagggatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctggccttgatggctactttcaaaatgagaccaatgttcgctgttgggctattatttcgcagactaacatccagagaagttcttcttctcacgattggattaagcctggtggcatccgtggagttaccaaattctttggaggagctaggggatggacttgcaatgggtatcatgatgttaaaattattgactgaattccagccacaccagttatggaccaccttactgtctttgacatttatcaaaacaactctttcattggattatgcatggaggacaatggctatggtgctgtcaatcgtatctctctttcctttatgtctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggccattggaatagtcagcattctactaagttcactccttaaaaatgatgtgccgttagccggcccactaatagctggaggcatgctaatagcatgttatgtcatatccggaagctcagccgatttatcattggagaaagcggctgaggtatcctgggaagaagaagcagaacactctggtacctcacacaacatattagtagaggtccaagatgatggaaccatgaaaataaaagatgaagagagggatgacacgctcaccatactcctcaaagcaactctgctggcagtctcaggagtgtacccaatgtcaataccagcaactcttttcgtgtggtatttttggcagaaaaagaaacagagatcaggagtgttatgggacacacccagccctccggaagtggaaagagcagttcttgatgatggcatctatagaatcctgcaaagaggactgttgggcaggtcccaagtaggagtgggagttttccaagacggcgtgttccacacaatgtggcacgtcaccaggggagctgtccttatgtaccaagggaagaggttggaaccaagctgggccagtgtcaaaaaggacttgatctcatatggaggaggttggagatttcaaggatcatggaacacgggagaagaggtgcaggtgatagctgttgaaccaggaaaaaatcccaaaaatgtacagacaacgccgggtaccttcaagactcccgaaggcgaagttggagccatagctctagattttaaacccggcacatctggatctcccatcgtgaacagagagggaaaaatagtaggtctttatggaaatggagtggtgacaacaagtggaacctacgtcagtgccattgcccaagctaaaacatcacaagaagggcctctaccagagattgaggacgaggtgtttaagaaaaggaacttaacaataatggacctgcatccaggatcgggaaaaacaagaagatatcttccagccatagtccgtgaggccataaaaaggaaactgcgcacgttaatcttggctcccacaagagttgtcgcctctgaaatggcagaggcgctcaagggaatgccaataagatatcagacaacagcagtgaagagtgaacacacaggaagggagatagttgacctcatgtgccacgccactttcaccatgcgtctcttatctccagtgagagttcccaattacaacatgattatcatggatgaagcacattttaccgatccagccagcatagcggccagagggtacatctcgactcgagtgggtatgggtgaagcagctgcgatctttatgacagccactcccccaggatcggtggaggcctttccacaaagcaatgcagttatccaagatgaggaaagagacattcctgagagatcatggaactcaggctacgactggatcactgattttccaggtaaaacagtctggtttgttccaagcattaagtcaggaaatgacattgctaactgtttaagaaagaacggaaaacgggtgatccaattgagcagaaaaacctttgacactgagtaccagaaaacaaaaaacaatgattgggactatgttgtcacaacagacatttccgaaatgggggcaaatttccgggccgacagggtaatagacccaaggcggtgcttgaaaccagtgatactaaaagatggtccagagcgtgtcattctagccggaccgatgccagtgactgtggccagtgctgcccagagaagaggaagaattggaaggaaccaaaacaaggaaggtgatcagtacgtttatatgggacagcctttaaataatgatgaggaccacgctcattggacagaagcaaaaatgctccttgacaatataaacacaccagaagggatcattccagccctctttgagccagagagagaaaagagtgcagcaatagacggggagtacagactgcggggagaagcaaggaaaacgttcgtggagctcatgagaagaggagatctaccagtttggctatcctacaaagttgcctcagaaggtttccagtactccgacagaaggtggtgctttgatggggaaaggaacaaccaggtgttggaggagaacatggacgtagagatctggacaaaggaaggagaaagaaagaaattgcgaccccgctggttggatgccagaacatactctgatccactggcccttcgtgagttcaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgctatggaggaactaccagacaccatagaaacattgatgctcctagctttgatagctgtgctgactggtggagtgacgctgttctttctatcaggaaaaggactagggaaaacatccattggcctgctctgtgtgatggcctcaagcgcactgttatggatggccaatgtggagccacattggatagcggcctccatcatactagagttctttctgatggtgctgctcattccagagccagacagacagcgcactccacaggacaaccagctagcatacgtggtgataggtttgttattcataatactgacagtggcagccaatgagatgggactattggaaaccacaaagaaagacctggggattggccatgtagccgccgaaagccaacaccatgccacgatgctggacgtagacctacgcccagcttcagcctggaccctctatgcagtagccacaacagttatcactcccatgatgagacacacaattgaaaacacaacggcaaacatttccctgacagccattgcaaaccaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagttaggccaaataatgttactgatactttgtacatcacagattctcctgatgcggaccacatgggccttgtgtgaatccatcacactggctactggacccttgaccactctctgggagggatctccaggaaaattctggaataccacgatagcagtgtccatggcaaacatcttcaggggaagttatctagcaggagcaggtctggccttctcgttaatgaaatccttgggaggaggcaggagaggtacgggggctcaaggagaaacactgggagagaaatggaaaagacagttaaaccaactgagcaagtcagaattcaacacctacaaaaggagtgggattatggaggtggacagatccgaagccaaagagggattaaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtcaagggatacacaaaaggaggacctggacatgaggaacctatcccaatggcgacctatggatggaacctagtaaagctatactctggaaaagatgtattttttacaccacctgagaaatgtgatacccttctgtgtgatataggagagtcttctccgaatccaaccatagaagaaggaagaacgttacgtgttctaaagatggtagaaccatggcttagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaagacaatccatacaaaacatgggcctatcatggatcatatgaggtcaaaccatcaggatcagcctcatctatggtgaatggcgtggtgagattgctcacaaaaccatgggatgtcatccccatggtcacacaaatagccatgaccgataccacacccttcggacaacagagagtgtttaaagagaaagtagacacgcgcacaccaagagcaaaacgaggcacagcacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctagagttcgaagcccttggtttcatgaatgaagatcactggttcagtagagagaattcattcagtggagtggaaggagaaggactgcacaaacttggatacatactcagagacatatcaaagatcccggggggaaatatgtatgcagatgacacagccggatgggacacaagaataacagaggatgatcttcagaatgaggctaaaatcactgacatcatggagcctgaacacgctctattggctacgtcaatttttaagctgacctaccaaaacaaggtggtaagggtgcaaagaccagcaaaaaatggaaccgtgatggatgttatatccagacgagaccagagaggaagtgggcaggtcggaacctatggcttaaatactttcaccaatatggaggtccaactaataagacaaatggagtctgaaggaatctttttacccagcgaattggaaacccccaatctagctgagagagttcttgactggttggaaaaacatggcaccgaaaggctgaaaagaatggcaatcagcggagatgattgtgtggtgaaaccagttgatgacaggtttgcaacagccttaatagctctgaatgacatgggaaaagtaagaaaagatataccgcagtgggaaccttcaaaaggatggaatgactggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaatgctatctgttcagctgtcccagttgactgggtcccaactagccgcacaacctggtcaatccatgctcaccatcaatggatgacaacagaagacatgttatcagtgtggaatagggtttggatagaggaaaacccatggatggaggacaaaactcatgtatccagctgggaagaagtcccatacttagggaaaagggaagatcaatggtgtggatccctgataggcttgacagcgagggccacttgggccactaacatacaagtagccataaaccaagtgagaaggctcatcgggaatgagaattatctagattacatgacatcaatgaagagattcaagaatgagagtgatcccgaaggggcactctggtaa

SEQ ID NO: 5585 - RNA, 9879 nt, synthetic construct
  misc_feature 1..9879: note = derived and/or modified CDS sequence (wt) from DENV-1__FJ410184__SS-prME
  source 1..9879: mol_type = other RNA
tctgtgaccatgctcctcatgctgctgcccacagccctggcgttccatttgaccacacgagggggagagccacatatgatagttagtaagcaggaaagaggaaagtcactgttgtttaagacctctgcaggtatcaatatgtgcactctcattgcgatggatttgggagagttatgcgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaaaagtggagacttgggctttgagacacccaggattcacggtgatagccctttttttagcacatgccataggaacatccatcactcagaaagggatcatcttcatcttgctgatgctagtaacaccatcaatggccatgcgatgtgtgggaataggtaacagagacttcgttgaaggactgtcaggagcaacgtgggtggacgtggtattggagcatggaagctgcgtcaccaccatggcaaaagataaaccaacattggacattgaactcctgaagacggaggtcacgaaccctgccgtcctgcgcaaactgtgcattgaagctaaaatatcaaacaccaccaccgattcaaggtgtccaacacaaggagaggctacactggtggaagaacaagacgcgaactttgtgtgtcgacgaacgtttgtggacagaggctggggtaatggctgcggactatttggaaaaggaagcctactgacgtgtgctaagttcaagtgtgtgacgaaactagaaggaaagatagttcaatatgaaaacttaaaatattcagtgatagtcactgtccacactggggaccagcaccaggtgggaaacgagactacagaacatggaacaattgcaaccataacacctcaagctcctacgtcggaaatacagctgactgactacggagccctcacattggactgctcacctagaacagggctggactttaatgagatggtgctattgacaatgaaagaaaaatcatggcttgtccacaaacaatggtttctagacttaccactgccttggacttcgggagcttcaacatctcaagagacttggaacagacaagatttgctggtcacattcaagacagctcatgcaaagaaacaggaagtagtcgtactgggatcacaagagggagcaatgcacactgcgttgactggagcgacagaaatccagacgtcgggaacgacaacaatctttgcaggacacctgaaatgcagactaaaaatggataaactgactttaaaagggatgtcatatgtgatgtgcacaggctcatttaagctagagaaggaagtggctgagacccagcatggaactgttctagtgcaggttaaatacgaaggaacagatgcgccatgcaagatccctttttcggcccaagatgagaaaggagtgacccagaatgggagattgataacagccaaccccatagtcactgacaaagaaaaaccagtcaacattgagacagaaccaccttttggtgagagctacatcgtggtaggggcaggtgaaaaagctttgaaactgagctggttcaagaaagggagcagcatagggaaaatgttcgaagcaaccgcccgaggagcacgaaggatggctatcctgggagacaccgcatgggactttggttctataggaggagtgttcacgtcagtgggaaaattggtacaccaggtttttggaaccgcatatggggttttgttcagcggtgtttcttggaccatgaaaataggaatagggattctactgacatggttgggattaaattcaaggagcacgtcactttcgatgacgtgcattgcggttggcatggtcacactgtacctaggagtcatggttcaagcggactcgggatgtgtaatcaactggaagggcagagaactcaaatgtggaagtggtatttttgtcactaatgaagtccacacttggacagagcaatacaaattccaggctgactccccaaaaagactgtcagcagccattgggaaggcatgggaggagggcgtgtgtggaattcgatcagccacacgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacagatactcatggaaaagctggggaaaagccaaaatcataggagcagacatacagaataccaccttcatcatcgacggcccagatactccagaatgccccgatgaccaaagagcgtggaacatttgggaagttgaggactatgggtttggaattttcacgacaaacatatggctgaaattgcgcgactcctacacccaaatgtgtgaccaccggctaatgtcagctgccatcaaggacagcaaggcagtccatgctgacatggggtactggatagaaagtgaaaagaacgagacctggaagctagcgagagcctccttcatagaagtcaagacatgcatctggccgaaatcccacactctatggagtaatggagttttggaaagtgaaatgataatcccaaagatatatggaggaccaatatctcagcacaactacagaccagggtatttcacacaaacagcagggccatggcacctaggcaagttggaattggattttgacttgtgtgaaggtaccacagttgttgtggatgaacattgtggaaatcgaggtccatctctcagaactacaacagtcacaggaaagataatccatgaatggtgttgcagatcctgcacgttaccccccttacgcttcagaggagaagacggatgttggtatggcatggaaatcagaccagttaaggagagggaggaaaacctagttaagtcaatggtctctgcagggttaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctggccttgatggctactttcaaaatgagaccaatgttcgctgttgggctattatttcgcagactaacatccagagaagttcttcttctcacgattggattaagcctggtagcatccgtggagttaccaaattctttggaggagctaggggatggacttgcaatgggtattatgatgttaaaattattgactgaatttcagccacaccagttatggaccaccttactgtctttgacatttatcaaaacaactctttcattggattatgcatggaagacaatggctatggtgctgtcaatcgtatctctctttcctttatgtctttctacgacctcccaaaaaacaacatggcttccggtgttgttaggatctcttggatgcaaaccattaaccatgtttcttataacagaaaacaaaatttggggaaggaaaagttggcccctcaatgaaggaattatggctattggaatagtcagcattctactaagttcactccttaaaaatgatgtgccgttagccggcccactaatagctggaggcatgctaatagcatgttacgtcatatccggaagctcagccgatttatcattggagaaagcggctgaggtatcctgggaagaagaagcagaacactctggcacctcacacaacatattggtagaggtccaagatgatggaactatgaaaataaaagatgaagagagggatgacacactcaccatactccttaaagcaactctgctggcagtctcaggagtgtacccaatgtcaataccagcaactcttttcgtgtggtatttttggcagaaaaagaaacagagatcaggagtgttatgggacacgcccagccctccagaagtggaaagagcagttcttgatgatggcatctatagaatcctgcaaagaggactgttgggcaggtcccaagtaggagtgggagtttttcaagacggcgtgttccacacaatgtggcacgtcaccaggggagctgttcttatgtaccaagggaagaggctggaaccaagctgggccagtgtcaaaaaggacttgatctcatatggaggaggttggaggtttcaaggagcatggaacacgggagaagaagtgcaggtgatagctgttgaaccaggaaaaaaccccaaaaatgtacagacaacgccgggcaccttcaagactcccgaaggcgaagttggagccatagctctagattttaaacccggcacatctggatctcccatcgtgaacagagagggaaaaatagtaggtctttatggaaatggagtggtgacaacaagtggaacctacgtcagtgccattgcccaagctaaaacatcacaagaagggtctctaccagagattgaggacgaggtgtttaagaaaaggaacttaacaataatggacctgcatccaggatcaggaaaaacaagaagatatcttccagccatagtccgtgaggccataaaaaggaaactgcgcacgttaatcttggctcccacaagagttgttgcctctgaaatggcagaggcgctcaagggaatgccaataagatatcagacaacagcagtgaagagtgaacacacaggaagggagatagttgacctcatgtgccacgccacttttaccatgcgtctcttatctccagtaagagttcccaattacaacatgattatcatggatgaagcacattttaccgatccagccagcatagcagccagagggtacatctcaacccgagtgggtatgggtgaagcagctgcgatctttatgacagccactcccccaggatcggtggaggcctttccacaaagcaatgcagttatccaagatgaggaaagagacattcctgagagatcatggaactcaggctacgactggatcactgattttccaggtaaaacagtctggtttgttccaagcatcaaatcaggaaatgacattgctaactgtttaagaaaaaacggaaaacgggtgatccaattgagcagaaaaacctttgacactgagtaccagaaaacaaaaaacaatgattgggactatgttgtcacaacagacatttccgaaatgggggcaaatttccgggccgacagggtaatagacccaaggcggtgcttgaaaccagtgatactaaaagatggtccagagcgtgtcattctagccggaccgatgccagtgactgtggccagtgctgcccagaggagaggaagaattggaaggaaccaaaacaaggaaggtgatcagtacgtttacatgggacagcctttaaataatgatgaggatcacgctcattggacagaagcaaaaatgctccttgacaatataaacacaccagaagggatcattccagccctctttgagccagagagagaaaagagtgcagcaatagatggggagtatagactgcggggagaagcaaggaaaacgttcgtggagctcatgagaagaggagatctaccagtttggctatcctacaaagttgcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccactggcccttcgtgagttcaaagagtttgcagcaggaagaagaagtgtctcaggtgacctaatattggaaatagggaaacttccacaacatttgacgctaagagcccagaatgctctggacaacttggtcatgttgcacaattccgaacaaggaggaaaagcttatagacatgctatggaggaactaccagacaccatagaaacattgatgctcctagctttgatagctgtgctgactggtggagtgacgctgttcttcctatcaggaaaaggtctagggaaaacatccattggcctgctctgtgtgatggcctcaagcgcactgttatggatggccagtgtggagccccattggatagcggcctccatcatactagagttctttctgatggtgctgctcattccagagccagacagacagcgcactccacaggacaaccagctagcatacgtggtgataggtttgttattcatgatactgacagtggcagccaatgagatgggactattggaaaccacaaagaaagacctggggattggctatgtagccgccgaaaaccaccaccatgccacaatgctggacgtagacctacgtccagcttcagcctggaccctctatgcagtagccacaacagtcatcactcccatgatgagacacacaattgaaaatacaacggcaaacatttccctgacagccattgcaaaccaggcggctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttacgatgcaaaatttgaaaaacagttaggccaaataatgttactgatactttgtacatcacagattctcttgatgcggaccacatgggccttgtgtgaatccatcacactggctactggacccttgaccactctctgggagggatctccaggaaaattctggaataccacgatagcagtgtccatggcaaacatcttcaggggaagttatctagcaggagcaggtctggccttctcgttaatgaaatctttaggaggaggcaggagaggtacaggggctcaaggagaaacactgggagagaaatggaaaagacagttaaaccaactgagcaagtcagaattcaacacctacaaaaggagtgggattatggaggtggacagatccgaagccaaagagggattaaaaagaggagaaacaaccaaacatgcagtgtcgagaggaacagccaaactgaggtggtttgtggagagaaacctcgtgaaaccagaagggaaagtcatagacctcggttgtggaagaggtggctggtcatattattgtgctgggctgaagaaagtcactgaagtgaaaggatatacaaaaggaggacctggacatgaggaacctatcccaatggcgacctatggatggaacctagtaaagctacactctggaaaagatgtattttttacaccacctgagaaatgtgatacccttctgtgtgacattggagagtcctctccgaatccaactatagaagaaggaagaacgttacgtgttctaaagatggtagaaccatggctcagaggaaaccaattctgcataaaaatcctaaatccttacatgccaagtgttgtagaaactctggagcaaatgcaaagaaaacatggagggatgctagtgcgaaatccactctcaagaaattccactcatgaaatgtactgggtttcatgtggaacaggaaacattgtgtcagcagtgaacatgacatccagaatgttactgaatcgattcacaatggctcacaggaagccaacatatgaaagagacgtggacttaggcgctgggacaagacatgtggcagtggagccagaggtagccaacctagatatcattggccagaggatagagaatataaaaaatgaacacaagtcaacatggcattatgatgaagacaatccatacaaaacatgggcctatcatggatcatatgaggtcaaaccatcaggatcagcctcatctatggtcaatggcgtggtgagattgctcacaaaaccatgggatgttatccccatggtcacacaaatagccatgactgatactacacccttcggacaacaaagagtgtttaaagagaaagttgacacgcgcacaccaagagcaaaacgaggcacagcacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagccgtgcaatatggtacatgtggctgggagcacgctttctagagttcgaagcccttggtttcatgaatgaagatcactggttcagtagagagaattcattcagtggagtggagggagaaggactgcacaaacttggatacatactcagagacatatcaaagattccggggggaaatatgtatgcagatgatacagccggatgggacacaagaataacagaggatgatcttcagaatgaggctaaaatcactgacattatggagcctgaacacgctctattggctacgtcaatttttaagctgacctaccaaaacaaggtggtaagggtgcaaagaccagcaaaaaatggaaccgtgatggatgttatatccagacgtgaccagagaggaagcgggcaggtcggaacctatggcttaaatactttcaccaatatggaggtccaactaataagacaaatggagtctgaaggaatctttttacccagcgaattggaaacccccaatctagctgagagagttcttgactggttggaaaaacatggcaccgaaaggctgaaaagaatggcaattagcggagatgattgtgtggtgaaaccagttgatgacaggttcgcaacagccttaatagctctgaatgacatgggaaaagtaagaaaagacataccgcagtgggaaccttcaaaaggatggaatgactggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaatgctatctgttcagctgtcccagttgactgggtcccaaccagccgcacaacctggtcaatccatgctcaccaccaatggatgacaacagaagacatgttatcagtgtggaatagggtttggatagaggaaaacccatggatggaggacaaaactcatgtatctagctgggaagaagttccatacctaggaaaaagggaagatcaatggtgtggatccctgataggcttgacagcgagggccacttgggccactaacatacaagtggccataaaccaagtgagaaggctcatcgggaatgagaattatctagattacatgacatcaatgaagagattcaagaatgagagtgatcccgaaggggcactctggtaa

SEQ ID NO: 5586 - RNA, 9879 nt, synthetic construct
  misc_feature 1..9879: note = derived and/or modified CDS sequence (wt) from DENV-1__FJ410185__SS-prME
  source 1..9879: mol_type = other RNA
tctgtgaccatgctcctcatgctgctgcccacagccctggcgttccatttgaccacacgagggggagagccacacatgatagttagtaagcaggaaagaggaaagtcactgttgtttaagacctctgtaggcatcaatatgtgcactctcattgcgatggatttgggagagttatgcgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggacttggtctagaaacaagaaccgaaacatggatgtcctctgaaggtgcctggaaacaaatacaaaaagtggagacttgggctttgagacacccaggattcacggtgatagccctttttttagcacatgccataggaacatccattactcagaaagggatcattttcattttgctgatgctagtaacaccatcaatggccatgcgatgtgtgggaataggcaacagagacttcgttgaaggactgtcaggagcaacgtgggtggacgtggtattggagcatggaagctgcgtcaccaccatggcaaaagataaaccaacattggacattgaactcttgaagacggaggtcacaaaccctgccgtcttgcgcaaactgtgtattgaagctaaaatatcaaacaccaccaccgattcaaggtgtccaacacaaggagaggctacactggtggaagaacaagactcgaactttgtgtgtcgacgaacgtttgtggacagaggctggggtaatggctgcggactatttggaaaaggaagcttactgacgtgtgctaagttcaagtgtgtgacaaaactagaaggaaagatagttcaatatgaaaacttaaaatattcagtgatagtcactgtccacactggggaccagcaccaggtgggaaacgagaccacagaacatggaacaattgcaaccataacacctcaagctcctacgtcggaaatacagctgactgactacggagccctcacattggactgctcgcctagaacagggctggactttaatgagatggttctattgacaatgaaagaaaaatcatggcttgtccacaaacaatggtttctagacttaccactgccttggacttcaggagcttcaacatctcaagagacttggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacacctgaaatgcagactaaaaatggataaattgactttaaaagggatgtcatatgtaatgtgcacaggctcatttaagctagagaaggaagtggctgagacccagcatggaactgttctagtgcaggttaaatacgaaggaacagatgcgccatgcaagatccctttttcggcccaagatgagaagggagtgacccagaatgggagattgataacagccaaccccatagtcactgacaaagaaaaaccagtcaacattgagacagaaccaccttttggtgagagctacatcgtgataggggcaggtgaaaaagctttgaaactgagctggttcaagaaagggagcagcatagggaaaatgttcgaagcaactgcccgaggagcacgaaggatggctatcctgggagacaccgcatgggactttggctctataggaggagtgttcacatcagtgggaaaattggtacaccaggtttttggagccgcatatggggttctgttcagcggtgtttcttggaccatgaaaataggaatagggattctgctgacatggttgggattaaattcaaggagcacgtcactttcgatgacgtgcattgcggttggcatggtcacactgtacctaggagtcatggttcaagcggactcaggatgtgtaatcaactggaagggcagagaactcaaatgtggaagtggtatttttgtcactaatgaagtccacacttggacagagcaatacaaattccaggctgactccccaaaaagactgtcagcagccattgggaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgattaggccacaacccatggaacatagatactcatggaaaagctggggaaaagccaaaatcataggagcagacatacagaataccaccttcatcatcgacggcccagatactccagaatgccccgatgaccaaagagcgtggaacatttgggaagttgaagactatgggtttggaattttcacgacaaacatatggctgaaattgcgcgactcctacacccaaatgtgtgaccaccggctaatgtcagctgccatcaaagacagcaaggcagtccatgctgacatggggtactggatagaaagtgaaaagaacgagacctggaagctagcgagagcctccttcatagaagtcaagacatgtatctggccgaaatcccacactctatggagtaatggagttttggaaagtgaaatgataatcccaaagatatatggaggaccaatatctcaacacaactacagaccagggtatttcacacaaacagcagggccatggcatctaggcaagttggaattggattttgacttgtgtgaaggtaccacagttgttgtggatgaacattgtggaaatcgaggtccatctctcagaactacaacagtcacaggaaagataatccatgaatggtgttgcagatcctgcacgttaccccccttacgcttcagaggagaagacggatgttggtatggcatggaaatcagaccagttaaggagaaggaggaaaacctagttaggtcaatggtctctgcagggtcaggagaagtagacagtttttcactagggatactatgcgtatcaataatgattgaagaagtgatgagatccagatggagtagaaagatgctgatgactggaacattggctgttttcctccttcttataatgggacaactgacatggaatgatctgattaggttatgcatcatggttggagctaatgcttcagacaggatggggatgggaacaacgtacctggccttgatggctactttcaaaatgagaccaatgttcgctgttgggctattatttcgcagactaacatccagagaagttcttcttctcacgattggattaagcctagtggcatccgtggagttaccaaattctttggaggagctaggggatggacttgcaatgggtatcatgatgttaaaattattgactgaatttcagccacaccagttatggaccaccttactgtctttgacatttatcaaaacaactctttcattggattatgcatggaggacaatggctatggtgctgtcaatcgtatctctctttcctttatgtctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactccttaaaaatgatgtgccgttagccggcccactaatagccggaggcatgctaatagcatgttatgtcatatccggaagctcagccgatttatcattggagaaagcggctgaggtatcctgggaagaagaagcagaacactctggtacctcacacaacatattagtagaggtccaagatgatggaactatgaaaataaaagatgaagagagggatgacacactcaccatactcctcaaagcaactctgctggcagtctcaggagtgtacccaatgtcaataccagcaactcttttcgtgtggtatttttggcagaaaaagaaacagagatcaggagtgttatgggacacacccagccctccggaagtggaaagagcagttcttgatgatggcatctatagaatcctgcaaagaggactgttgggcaggtcccaagtaggagtgggagtcttccaagacggcgtgttccacacaatgtggcacgtcaccaggggagctgtccttatgtaccaagggaagaggttagaaccaagctgggccagtgtcaaaaaggacttgatctcatatggaggaggttggagatttcaaggatcatggaacacgggagaagaggtgcaggtgatagctgttgaaccaggaaaaaatcccaaaaatgtacagacaacgccgggtaccttcaagactcccgaaggcgaagttggagccatagctctagattttaaacccggcacatctggatctcccatcgtgaacagagaggaaaaaatagtaggtctttatggaaatggagtggtgacaacaagtggaacctacgtcagtgccattgcccaagctaaaacatcacaagaagggcctctaccagagattgaggacgaggtgtttaagaaaaggaacttaacaataatggacctgcatccaggatcgggaaaaacaagaagatatcttccagccatagtccgtgaggccataaaaaggaaactgcgcacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatctccagtgagagttcccaattacaacatgattatcatggatgaagcacattttaccgatccagccagcatagcggccagagggtacatctcaactcgagtgggtatgggtgaagcagctgcgatctttatgacagccactcccccaggatcggtggaggcctttccacaaagcaatgcagttatccaagatgaggaaagagacattcctgagagatcatggaactcaggctacgactggatcactgattttccaggtaaaacagtctggtttgttccaagcattaagtcgggaaatgacattgctaactgtttaagaaagaacggaaaacgggtgatccagttgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccagtgatactaaaagatggtccagagcgtgtcattctagccggaccgatgccagtgactgtggccagtgctgcccagagaagaggaagaattggaaggaaccaaaacaaggaaggtgatcagtacgtttatatgggacagcctttaaataatgatgaggatcacgctcattggacagaagcaaaaatgctccttgacaatataaacacaccagaagggatcattccagccctctttgagccagagagagaaaagagtgcagcaatagatggggagtacagactgcggggagaagcaaggaaaacgttcgtggagctcatgagaagaggagatctaccagtttggctatcctacaaagttgcctcagaaggtttccagtactccgacagaaggtggtgttttgatggggaaaggaacaaccaagtgttggaggagaacatggacgtggagatctggacaaaggaaggagaaagaaagaaattgcgaccccgctggttggatgccagaacatactctgatccactggcccttcgtgagttcaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgctatggaggaactaccagacaccatagaaacattgatgctcctagctttgatagctgtgctgactggtggagtgacgctgttcttcctatcaggaaaaggtctagggaaaacatccattggcctgctctgtgtgatggcctcaagcgcactgttatggatggccaatgtggagccacattggatagcggcctccatcatactagagttctttctgatggtgctgctcattccagagccagacagacagcgcactccacaggacaaccagctagcatacgtggtgataggtttgttattcatgatactgacagtggcagccaatgagatgggactattggaaaccacaaagaaagacctggggattggccatgtagccgccgaaaaccaacaccatgccacgatgctggacgtagacctacgcccagcttcagcctggaccctctatgcagtagccacaacagttatcactcctatgatgagacacacaattgaaaacacaacggcaaacatttccctgacagccattgcaaaccaggcagccatattgatgggacttgacaagggatggccaatatcgaagatggacataggagttccacttctcgccttagggtgctattcccaggtgaacccattgacactgacagcggcggtgttgatgttggtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagttaggccaaataatgttactgatactttgtacatcacagattctcttgatgcggaccacatgggccttgtgtgaatccatcacactggctactggacccttgaccactctctgggagggatctccaggaaaattctggaataccacgatagcagtgtccatggcaaacatcttcaggggaagttatctagcaggagcaggtctggccttctcgttaatgaaatctttgggaggaggcaggagaggtacgggggctcaaggagaaacactgggagagaaatggaaaagacagttaaaccaactgagcaagtcagaattcaacacctacaaaaggagtgggattatggaggtggacagatccgaagccaaagagggattgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtcaagggatacacaaaaggaggacctggacatgaggaacctatcccaatggcgacctatggatggaacctagtaaagctatactctggaaaagatgtattttttacaccacctgagaaatgtgatacccttctgtgtgatataggagagtcctctccgaatccaactatagaagaaggaagaacgttacgtgttctaaagatggtagaaccatggctcagaggaaaccaattctgcataaaaatcctaaatccttacatgccaagtgtggtagaaactctggagcaaatgcaaagaaaacatggagggatgctagtgcgaaacccactctcaagaaattctacccatgaaatgtactgggtttcatgtggaacaggaaacattgtgtcggcagtgaacatgacatccagaatgttactaaatcgattcacaatggctcacaggaagccaacatatgaaagagacgtggacttaggcgctggaacaagacatgtggcagtggaacctgaggtagccaacctagatatcattggccagaggatagagaacataaaaaatgaacacaagtcaacatggcattatgatgaagacaatccatacaaaacatgggcctatcatggatcatatgaggtcaaaccatcaggatcagcctcatctatggtgaatggcgtggtgagattgctcacaaaaccatgggatgtcatccccatggtcacacaaatagccatgaccgataccacacccttcggacaacagagagtgtttaaagagaaagtggacacgcgcacaccaagagcaaaacgaggcacagcacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaattgggagagtttggaaaggcaaaaggaagtcgtgcaatatggtacatgtggctgggagcacgctttctagagttcgaagcccttggtttcatgaatgaagatcactggttcagtagagagaattcattcagtggagtggaaggagaaggactgcacaaacttggatacatactcagagacatatcaaagatcccggggggaaatatgtatgcagatgacacagccggatgggacacaagaataacagaggatgatcttcagaatgaggccaaaatcactgacatcatggagcctgaacacgctctattggctacgtcaatttttaagctgacctaccaaaacaaggtggtaagggtgcaaagaccagcaaaaaatggaaccgtgatggatgttatatccagacgagaccagagaggaagtgggcaggtcggaacctatggcttaaatactttcaccaatatggaggtccaactaataagacaaatggagtctgaaggaatctttttacccagcgaattggaaacccccaatctagctgagagagttcttgactggctggaaaaacatggcaccgaaaggctgaaaagaatggcaattagcggagatgattgtgtggtgaaaccggttgatgacaggtttgcaacagccttaatagctctgaatgacatgggaaaagtaagaaaagacataccgcagtgggaaccttcaaaaggatggaatgactggcagcaagtgcctttctgttcacaccatttccaccagctgatcatgaaggatgggagggaaatagtggtgccatgccgtaaccaagatgaacttgtgggcagggctagagtatcacaaggcgccggatggagcctgagagaaactgcttgcctaggcaagtcatatgcacaaatgtggcagctgatgtacttccacaggagagacctaagactagcggctaatgctatctgttcagctgtcccagttgactgggtcccaaccagccgcacaacctggtcaatccatgctcaccatcaatggatgacaacagaagatatgttatcagtgtggaatagggtttggatagaggaaaacccatggatggaggataaaactcacgtatccagctgggaagaagtcccatacttaggaaaaagggaagatcaatggtgtggatccctgataggcttgacagcgagggccacttgggccactaacatacaagtagccataaaccaagtgagaaggctcatcgggaacgagaattatctagattacatgacatcaatgaagagattcaagaatgagagtgatcccgaaggggcactctggtaa

SEQ ID NO: 5587 - RNA, 9879 nt, synthetic construct
  misc_feature 1..9879: note = derived and/or modified CDS sequence (wt) from DENV-1__FJ547087__SS-prME
  source 1..9879: mol_type = other RNA
tccgtgaccatgctcctcatgctgctgcccacagccctggctttccatttgaccacacgagggggagagccacacatgatagttagtaagcaggaaagaggaaagtcactcttgttcaagacctctgcaggtgtcaatatgtgcactctcattgcgatggatttgggagaattatgtgaggacacaatgacctacaaatgcccccggatcactgaggcggaaccagatgacgttgactgctggtgcaatgccacagacacatgggtgacctatgggacgtgctctcaaaccggtgaacaccgacgagacaaacgttccgtggcactggccccacacgtgggacttggtctagaaacaagaaccgaaacatggatgtcctctgaaggcgcctggaaacaaatacaaaaagtggagacttgggctttgagacacccaggattcacggtgatagccctttttttagcacatgccataggaacatccatcactcagaaagggatcattttcattttgctgatgctggtaacaccatcaatggccatgcgatgcgtgggaataggcaacagagacttcgttgaaggactgtcaggagcaacgtgggtggacgtggtattggagcatggaagctgcgtcaccaccatggcaaaaaacaaaccaacattggacattgaactcttaaagacggaggtcacgaaccctgccgtcttgcgcaaattgtgcattgaagctaaaatatcaaacaccaccaccgattcaagatgtccaacacaaggagaggctacactggtggaagaacaagacgcgaactttgtgtgtcgacgaacgtttgtggacagaggctggggtaatggctgcggactatttggaaaaggaagcctactgacgtgtgctaagttcaagtgtgtgacaaaactggaaggaaagatagttcaatatgaaaacttaaaatattcagtgatagtcactgtccacacaggggaccagcaccaggtgggaaacgagactacagaacatggaacaattgcaaccataacaccccaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacttggaacagacaagatttgctggtcacattcaagacagctcatgcaaagaagcaggaagtagtcgtactgggatcacaggaaggagcaatgcacactgcgttgactggggcgacagaaatccagacgtcaggaacgacaacaatctttgcaggacacctgaaatgcagactaaaaatggataaactgactttaaaagggatgtcatatgtgatgtgcacaggctcatttaagctagagaaggaagtggctgagacccagcatggaactgtcctagtgcaggttaaatacgaaggaacagatgcaccatgcaagatccccttttcgacccaagatgagaaaggagtgacccagaatgggagattgataacagccaatcccatagttactgacaaagaaaaaccagtcaacattgagacagaaccaccttttggtgagagctacatcatggtaggggcaggtgaaaaagctttgaaactaagctggttcaagaaaggaagcagcatagggaaaatgttcgaagcaaccgcccgaggagcacgaaggatggctatcctgggagacaccgcatgggacttcggctctataggaggagtgttcacgtctgtgggaaaattggtacaccaggtttttggaaccgcatacggggttctgttcagcggtgtttcttggaccatgaaaataggaatagggatcctgctgacatggttgggattgaattcaaggagcgcgtcgctttcgatgacgtgcattgcagttggcatggttacactgtacctaggagtcatggttcaagcggactcgggatgtgtgatcaactggaagggcagagaactcaaatgtggaagtggcatttttgtcactaatgaagtccacacttggacagagcaatacaaattccaggctgactccccaaaaagactgtcagcagccattgggaaagcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgatcaggccacaacccatggaacacaaatactcatggaaaagctggggaaaagccaaaatcataggagcagacatacagaataccaccttcatcatcgacggcccagatactccagaatgccccgatgaccaaagagcgtggaacatttgggaagttgaggactatgggtttggaattttcacgacaaacatatggctgaaattgcgtgactcctacacccaaatgtgtgaccatcggctaatgtcagctgccatcaaggacagcaaggcagtccatgctgacatggggtactggatagaaagtgaaaagaacgagacctggaagctagcgagagcctccttcatagaagtcaagacatgcatttggccgaaatcccacactctatggagtaatggagttttggaaagtgaaatgataatcccaaagatatatggaggaccaatatctcagcacaattacagaccagggtatttcacacaaacagcagggccatggcacctaggcaagttggaattggattttgacttgtgcgaaggtaccacagttgttgtggatgaacattgtggaaatcgaggtccatctctcagaactacaacagtcacaggaaagataatccatgaatggtgttgcagatcctgcacgttaccccccttacgcttcagaggagaagacggatgttggtatggcatggaaatcagaccagttaaggagaaggaggagaacctagttaggtcaatggtctctgcagggtcaggagaagtggacagtttttcattgggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttctgacaggatggggatgggaacaacgtacctagccttgatggctactttcaaaatgagaccaatgttcgccgttgggttattatttcgcagactaacatccagagaggttcttcttctcacgattggattaagcctggtggcatccgtggagctaccaaattctttggaggaactaggggatggacttgcaatgggtatcatgatgttaaaattattgactgaatttcagccacaccagttatggaccaccttactgtctctgacatttatcaaaacaactctttcattggattatgcatggaagacaatggctatggtactgtcaatcgtatctctctttcctttatgtctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactcctcaaaaatgatgtgccgttagccggcccactaatagctggaggcatgctaatagcatgttatgtcatatccggaagctcagccgatttatcattggagaaagcggctgaggtatcctgggaagaagaagcggaacactctggtacctcacacaacatattagtagaggtccaagatgatggaactatgaaaataaaagatgaagagagggatgacacactcaccatactcctcaaagcaactctgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttgggcaggtcccaagtgggagtgggagttttccaagacggcgtgttccacacaatgtggcacgtcaccaggggagctgtccttatgtaccaagggaagaggctggaaccaagctgggccagtgtaaaaaaggacttgatctcatatggaggaggttggaggtttcaaggatcatggaacacgggagaagaagtgcaggtgatagctgttgaaccaggaaaaaaccccaaaaatgtacagacaacgccgggcaccttcaagactcccgaaggcgaagttggagccatagctctagattttaaacccggcacatctggatctcccattgtgaacagagagggaaaaatagtaggtctttatggaaatggagtggtgacaacaagtggaacctacgtcagtgccattgcccaagctaaagcatcacaagatgggcccctaccagagattgaggacgaggtgtttaagaaaagaaacttaacaataatggacctgcatccaggatcaggaaaaacaagaagatatcttccagccatagttcgtgaggccataaaaaggaaactgcgcacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatctccagtgagagttcccaattacaacatgattatcatggatgaagcacactttaccgatccagccagcatagcggccagagggtacatctcaacccgagtaggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgttccaagcattaaatcaggaaatgacattgccaactgtttaagaaagaacggaaaacgggtgatccaattgagcagaaaaacctttgacactgagtaccagaaaacaaaaaacaatgactgggactatgttgtcacaacagacatttccgaaatgggggcaaatttcagggccgacagggtaatagacccaaggcggtgcttgaaaccggtaatactaaaagatggtccagagcgcgtcattctagctggaccgatgccagtgactgtggccagtgctgcccagaggagaggaagaattggaaggaaccaaaacaaggaaggtgatcagtatgtttacatgggacagcctttaaataatgatgaggatcacgcccattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagttgcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccactggccctgcgcgagtttaaagagtttgcagcaggaagaagaagtgtctcaggtgacttaatattggaaatagggaaacttccacaacatttgacgataagagcccagaatgctctggataacttggtcatgttgcacaattccgaacaaggaggaaaagcctatagacatgctatggaggaactaccagacaccatagaaacattgatgctcctagctttgatagctgtgctgactggtggagtgacgctgttcttcctatcaggaaaaggtctagggaaaacatccattggcctgctctgtgtgatggcctcaagcgcactgttatggatggccagtgtggagccccattggatagcggcctccattatactagagttctttctgatggtgctgctcattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaccatgctacaatgctggacgtagacctacgtccagcttcagcctggaccctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaactgtagacgggattgttgcaatagacttggatcctgtggtttatgatgcaaaatttgaaaaacagctaggccaaataatgttactgatactttgtacatcacagattctcttgatgcggaccacatgggccttgtgtgaatccatcacactggctacaggacccttgaccactctctgggagggatctccaggaaaattctggaatactacgatagcagtgtccatggcaaacatcttcaggggaagttatctagcaggagcaggtctggccttctcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatctgaagccaaagagggattgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttacaccacctgagaaatgtgatacccttctgtgtgatattggtgagtcctctccgaacccaactatagaagaaggaagaacgttacgtgttctaaagatggtggaaccatggcttagaggaaaccaattctgcataaaaatcctaaatccttacatgccaagtgtggtagaaactctggagcaaatgcaaagaaaacatggagggatgctagtgagaaacccactctcaagaaattccacccatgaaatgtactgggtttcatgtggaacaggaaacattgtgtcggcagtgaacatgacatccagaatgttactgaatcgattcacaatggctcataggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaagacaatccatacaaaacatgggcctatcatggatcatatgaggtcaagccatcaggatcagcctcatctatggtgaatggcgtggtgagattgctcacaaaaccatgggatgttatccccatggtcacacaaatagctatgactgataccacgcccttcggacaacagagagtgtttaaagagaaagttgacacgcgcacaccaagagcaaaacgaggcacagcacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgcgccacgtgtgtctacaacatgatggggaagagagagaaaaaattaggagagtttggaaaggcaaaaggaagtcgtgcaatatggtacatgtggctgggagcacgctttctagagttcgaagcccttggtttcatgaatgaagatcactggttcagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacctaccaaaacaaggtggtgagggtgcaaagaccagcaaaaaatggaaccgtgatggatgttatatccagacgtgaccagagaggaagtggacaagtcggaacttatggcttaaatactttcaccaatatggaggtccaactaataagacaaatggagtctgaaggaatctttttaccctgcgaattggaaacccccaatctagctgagagagttcttgactggttggaaaaacatggcgccgaaaggctgaaaagaatggcaattagtggagatgattgtgtggtgaaaccaattgatgacaggttcgcaacagccttaatagctctgaatgacatgggaaaagtaagaaaagacataccgcagtgggaaccttcaaaaggatggaatgactggcagcaagtgcctttctgttcacaccatttccaccagctgatcatgaaggatgggagggaaatagtggtgccatgccgcaaccaagatgaacttgtgggtagggctagagtatcacaaggcgccggatggagcctgagagaaactgcttgcctaggcaagtcatacgcacaaatgtggcagctgatgtacttccacaggagagacctgagactagcggccaatgctatctgttcagccgttccagttgattgggtcccaaccagccgcacaacctggtcaatccatgcccaccaccaatggatgacgacagaagacatgttatcagtgtggaatagggtttggatagaggaaaacccatggatggaggacaaaactcatgtatccagttgggaagaagttccatacctagggaaaagggaagatcaatggtgtggatctctgataggcttgacagcgagggccacctgggccaccaacatacaagtagccataaaccaagtgagaaggctcatcgggaatgagaattacctagattacatgacatcaatgaagagattcaagaatgagagtgatcccgaaggggcactctggtaa

SEQ ID NO: 5588 - RNA, 9879 nt, synthetic construct
  misc_feature 1..9879: note = derived and/or modified CDS sequence (wt) from DENV-1__FJ410186__SS-prME
  source 1..9879: mol_type = other RNA
tccgtgaccatgctcctcatgctgctgcccacagccctggctttccatttgaccacacgagggggagagccacacatgatagttagtaagcaagaaagaggaaagtcactcttgttcaagacctctgcaggtgtcaatatgtgcactctcattgcgatggatttgggagagttatgtgaggacacaatgacctacaaatgcccccggatcactgaggtggaaccagatgacgttgactgctggtgcaatgccacagacacatgggtgacctatgggacgtgttctcaaaccggcgaacaccgacgagacaaacgttccgtggcattggccccacacgtgggacttggtctagaaacaagaaccgaaacatggatgtcctctgaaggcgcctggaaacaaatacaaaaagtggagacttgggctttgagacacccaggattcacggtgatagctttttttttagcacatgccataggaacatccatcactcagaaagggatcattttcattctgctgatgctggtaacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaattgtgcattgaagctaaaatatcaaacaccaccaccgattcaagatgtccaacacaaggagaggctacactggtggaagaacaagacgcgaactttgtgtgtcgacgaacgttcgtggacagaggctggggtaatggctgcggactatttggaaaaggaagcctactgacgtgtgccaagttcaagtgtgtgacaaaactggaaggaaagatagttcaatatgaaaacttaaaatattcagtgatagtcactgtccacacaggggaccagcaccaggtgggaaacgagactacagaacatggaacaattgcaaccataacacctcaagctcctacgtcggaaatacagctgaccgactacggagccctcacattggactgctcacctagaacagggctggactttaatgagatggtgctattgacaatgaaagaaaaatcatggctcgtccacaagcaatggtttctagacttaccactgccttggacttcgggggcttcaacatcccaagagacttggaacagacaagatttgctggtcacattcaagacagctcatgcaaagaagcaggaagtagtcgtgctgggatcacaggaaggagcaatgcacactgcgttgactggggcgacagaaatccagacgtcaggaacgacaacaatctttgcaggacacctgaaatgcagactaaaaatggataaactgactttaaaagggatgtcatatgtgatgtgcacaggctcattcaagctggagaaggaagtggctgagacccagcatggaactgtcctagtgcaggttaaatacgaaggaacagatgcgccatgcaagatccccttttcaacccaagatgagaaaggagtgacccagaatgggagattgataacagccaatcccatagttactgacaaagaaaaaccagtcaacattgagacagaaccaccttttggtgagagttacatcatagtaggggcaggtgaaaaagctttgaaactaagctggttcaagaaaggaagcagcatagggaaaatgttcgaagcaaccgcccgaggagcacgaaggatggctatcctgggagacaccgcatgggacttcggctctataggaggagtgttcacgtctgtgggaaaattggtacaccaggtttttggaactgcatacggggttctgttcagcggtgtttcttggaccatgaaaataggaatagggatcctgctgacatggttgggattgaattcaaggagcgcgtcgctttcgatgacgtgcattgcagttggcatggttacactgtacctaggagtcatggttcaagcggactcgggatgtgtaatcaactggaagggcagagaactcaaatgtggaagtggcatttttgtcactaatgaagtccacacttggacagaacaatacaaattccaggctgactccccaaaaagactgtcagcagccattgggaaggcatgggaggaaggcgtgtgtggaattcgatcagccacgcgtcttgagaacatcatgtggaagcaaatttcaaatgaattgaaccacattttacttgaaaatgacatgaaattcacagtggttgtaggagatgctaatggaattttggcccaaggaaaaaaaatgatcaggccacaacccatggaacacaaatactcatggaaaagctggggaaaagccaaaatcataggagcagacatacagaacaccaccttcatcatcgacggcccagatactccagaatgccccgatgaccaaagggcgtggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacctggaagctagcgagagcctccttcatagaagtcaagacatgcatttggccgaaatcccacactctatggagtaatggagttttggaaagtgaaatgataatcccaaagatatatggaggaccaacatctcagcacaattacagaccagggtacttcacacaaacagcagggccatggcacctaggcaagttggaattggattttgacttgtgtgaaggtaccacagtcgttgtggatgaacattgtggaaatcgaggtccatctctcagaacaacaacagtcacaggaaagataatccatgaatggtgttgcagatcctgcacgttaccccccttacgcttcagaggagaagacggatgttggtatggcatggaaatcagaccagttaaggagaaggaggagaatctagttaggtcaatggtctctgcagggtcaggagaagtggacagtttttcattgggaatattgtgcgtatcaataatgattgaagaagtgatgagatccagatggagtagaaagatgctgatgactggaacactggctgttttcctccttcttataatgggacaactgacatggaatgatctaattaggttatgcatcatggttggagccaatgcttctgataggatggggatgggaacaacgtacctagccttgatggctactttcaaaatgagaccaatgttcgctgtcgggttattatttcgcagactaacatccagagaagttcttcttctcacgattggattaagcctggtggcatccgtggagctaccaaattctttggaggagctgggggatggacttgcaatgggtatcatgatgctaaaattattgactgaatttcagccacaccagttatggaccaccttactgtctctgacatttatcaaaacaactctttcattggattatgcatggaagacaatggctatggtactgtcaatcgtatctctctttcccttatgtctgtctacgacctcccaaaaaacaacatggcttccggtgctgttaggatcttttggatgcaaaccattaaccatgtttcttataacagaaaacaaaatctggggaaggaaaagttggcccctcaatgaaggaatcatggctattggaatagtcagcattctactaagttcactcctcaaaaatgatgtgccgttagccggcccactaatagctggaggcatgctaatagcatgttatgtcatatccggaagctcagccgatttatcattggagaaagcggctgaggtatcctgggaagaagaagcagaacactctggtacctcacataacatattagtagaggtccaagatgatggaactatgaaaataaaagatgaagagagggatgacacactcaccatactcctcaaagcaaccctgctggcagtctcaggagtgtacccaatgtcaataccagcaactctttttgtgtggtatttttggcagaaaaagaaacagagatcaggagtgttatgggacacacccagccctccggaagtagaaagagcagttcttgatgatggcatctatagaattttgcaaagaggactgttgggcaggtcccaagtgggagtgggagttttccaagacggcgtgttccacacaatgtggcacgtcaccaggggagctgtccttatgtaccaagggaagaggctggaaccaagctgggccagtgtcaaaaaggacttgatctcatatggaggaggttggaggttccaaggactatggaacacgggagaagaagtgcaggtgatagctgttgaaccaggaaaaaaccctaaaaatgtacagacaacgccgggcaccttcaagactcccgaaggcgaagttggagccatagctctagattttaaacccggcacatctggatcccccattgtgaacagagagggaaaaatagtaggtctttatggaaatggagtggtgacaacaagtggaacctacgtcagtgccattgcccaagctaaagcatcacaagaagggcccctaccagagattgaggacgaggtgtttaaaaaaagaaacttaacaataatggacctgcatccaggatcaggaaaaacaagaagatatcttccagccatagtccgtgaggccataaaaaggaaactgcgcacgttaatcttggctcccacaagagttgtcgcctctgaaatggcagaggctctcaagggaatgccaataagatatcagacaacagcagtgaagagtgaacacacaggaagggagatagttgacctcatgtgccacgccacttttaccatgcgtctcttatctccagtgagagttcccaattacaacatgattatcatggatgaagcacattttaccgatccagccagcatagcagccagagggtacatctcaacccgagtgggtatgggtgaagcagctgcgatctttatgacagccactcccccaggatcggtggaggcctttccacagagcaatgcagttatccaagatgaggaaagagatattcctgagagatcatggaactcaggctacgactggatcactgattttccaggtaaaacagtctggtttgttccaagcattaaatcaggaaatgacattgccaactgtttaagaaagaacggaaaacgggtgatccaattgagcagaaaaacctttgacactgagtaccagaaaacaaaaaacaatgactgggactatgttgtcacaacagacatttccgaaatgggggcaaatttcagggccgacagggtaatagacccaaggcggtgcttgaaaccggtaatactaaaagatggtccagagcgcgtcattctagctggaccgatgccagtgactgtggccagtgctgcccagaggagaggaagaattggaaggaaccaaaacaaggaaggtgatcagtacgtttacatgggacagcctttaaacaatgatgaggatcacgctcattggacagaagcaaaaatgctccttgacaacataaacacaccagaagggatcatcccagccctctttgagccagagagagaaaagagtgcagcaatagacggggagtacagactgcggggggaagcaaggaaaacgttcgtggagctcatgagaagaggagatctaccagtttggctatcctacaaagttgcctcagaaggtttccagtactccgacagaaggtggtgctttgatggggaaaggaacaaccaggtgttggaggagaacatggacgtggagatttggacaaaggaaggagaaagaaagaaattgcgaccccgctggttggatgccagaacatattctgatccactggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgctatggaggaactaccagacaccatagaaacattgatgctcctagctttgatagctgtgctgactggtggagtgacgctgttcttcctatcaggaaaaggtctagggaaaacatccattggcctgctctgtgtgatggcctcaagcgcactgttatggatggcaagtgtggagccccactggatagcggcctccatcatactagagttctttctgatggtgctgctcattccagagccagacagacaacgcactccacaggacaaccaactagcatatgtggtgataggtttgttattcatgatactgacagtggcagccaatgagatgggattattggaaaccacaaagaaagacctggggattggccatgtagccgccgaaaatcaccaccatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgctgatgttagtggctcattatgccataattggaccaggactgcaagcaagggccactagagaagctcaaaaaaggacagcggccggaataatgaaaaatccaaccgtagacgggattgttgcaatagacttggatcctgtggtttatgacgcaaaatttgaaaaacagctaggccaaataatgttactgatactttgtacatcacagattctcttgatgcggaccacatgggccttgtgtgaatccatcacactggctactggacccttgaccactctctgggagggatctccagggaaattctggaataccacgatagcagtgtccatggcaaacatcttcaggggaagttatctagcaggagcaggtctggccttctcattaatgaaatctttaggaggaggtaggagaggtacgggagctcaaggggaaacactgggagagaaatggaaaaggcagttaaaccaactgagcaagtcagaattcaacacctacaaaaggagtgggattatggaggtggacagatctgaagccaaagagggattgaaaagaggagaaacaaccaaacatgcagtgtcgagaggaacagccaaactgaggtggtttgtggagaggaaccttgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttacaccacctgagaaatgtgataccctgctgtgcgatattggtgagtcctctccgaatccaactatagaagaaggaagaacgttacgtgttctaaagatggtggaaccatggcttagaggaaaccaattctgcataaaaatcctaaatccttacatgccaagtgtggtagaaactctggagcaaatgcaaaggaaacatggagggatgctagtgagaaacccactctcaagaaattccacccatgaaatgtactgggtttcatgtggaacaggaaacattgtgtcggcagtgaacatgacatccagaatgttactgaatcgattcacaatggctcataggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaagacaatccatacaaaacatgggcctatcatggatcatatgaggtcaagccatcaggatcagcctcatctatggtgaatggcgtggtgagattgctcacaaaaccatgggatgttatccccatggtcacacaaatagctatgactgacaccacacccttcggacaacagagagtgtttaaagagaaagttgacacgcgcacaccaagagcaaaacgaggcacagcacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatcttgtgcgcagagagagggagcttcataaacagggaaaatgcgccacgtgtgtctacaacatgatggggaagagagagaaaaaattaggagagtttggaaaggcaaaaggaagtcgtgcaatatggtacatgtggctgggagcacgctttctagagtttgaagcccttggtttcatgaatgaagatcactggttcagtagagagaattcactcagtggagtggaaggagaaggactgcacaaacttggatacatactcagagacatatcaaagattccggggggaaatatgtatgcagatgatacagccggatgggacacaagaataacagaggatgaccttcagaatgaggctaaaatcactgacatcatggagcctgaacatgctctattggctacgtcaatttttaagcttacctaccaaaacaaggtggtgagggtgcaaagaccagcaaaaaatggaactgtgatggatgttatatccagacgtgaccagagaggaagtggacaggtcggaacttatggcttaaatactttcaccaatatggaggtccaactaataagacaaatggagtctgaaggaatctttttgcccagcgaactggaaacccccaatttagctgagagagtccttgactggttggaaaaacatggcgccgagaggctgaaaagaatggcaattagtggagatgattgtgtggtgaaaccagttgatgacaggttcgcaacagccttaatagctctgaatgacatgggaaaagtaagaaaagacataccgcagtgggaaccctcaaaaggatggaatgactggcagcaagtgcctttctgctcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatacgcacaaatgtggcagctgatgtacttccacaggagagacctgagactggcggctaatgctatctgttcagccgacccagttgattgggtcccaaccagccgcacaacttggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatctctgataggcttgacagcgagggccacctgggccaccaacatacaagtagccataaaccaagtgagaaggctcatcgggaatgagaattatctagattacatgatatcaatgaagagattcaagaatgagagtgatcccgaaggggcactctggtaa

SEQ ID NO: 5589 - RNA, 9879 nt, synthetic construct
  misc_feature 1..9879: note = derived and/or modified CDS sequence (wt) from DENV-1__FJ410187__SS-prME
  source 1..9879: mol_type = other RNA
tctgtgaccatgctcctcatgctgctgcccacagccctggcgttccatttgaccacacgagggggagagccacacatgatagttagtaagcaggaaagaggaaagtcactgttgtttaagacctctgcaggcatcaatatgtgcactctcattgcgatggatttgggagagttatgcgaggacacaatgacctacaaatgcccccggatcactgaggcggaaccagatgacgttgactgctggtgcaatgccacagacacatgggtgacctatgggacatgttctcaaaccggcgaacaccgacgagacaaacgttccgtggcactggccccacacgtgggacttggtctagaaacaagaaccgaaacatggatgtcctctgaaggtgcctggaaacaaatacaaaaagtggagacttgggctttgagacacccaggattcacggtgacagccctttttttagcacatgccataggaacatccattactcagaaagggatcattttcattttgctgatgctagtaacaccatcaatggccatgcgatgtgtgggaataggcaacagggacttcgttgaaggactgtcaggagcaacgtgggtggacgtggtattggagcatggaagctgcgtcaccaccatggcaaaagataaaccaacattggacattgaactcttgaagacggaggtcacaaaccctgccgtcttgcgcaaactgtgcattgaagctaaaatatcaaacaccaccaccgattcaaggtgtccaacacaaggagaggccacactggtggaagaacaagactcgaactttgtgtgtcgacgaacgtttgtggacagaggctggggtaatggctgcggactatttggaaaaggaagcctactgacgtgtgctaagttcaagtgtgtgacaaaactagaaggaaagatagttcaatatgaaaacttaaaatattcagtgatagtcactgtccacactggggaccagcaccaggtgggaaacgagactacagaacatggaacaattgcaactataacacctcaagctcctacgtcggaaatacagctgactgactacggagccctcacattggactgctcacctagaacagggctggactttaatgagatggttctattgacaatgaaagaaaaatcatggcttgtccacaaacaatggtttctagacttaccactgccttggacttcaggagcttcaacatctcaagagacttggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacacctgaaatgcagactaaaaatggataaactgactttaaaagggatgtcatatgtaatgtgcacaggctcatttaagctagagaaggaagtggctgagacccagcatggaactgttctagtgcaggttaaatacgaaggaacagatgcgccatgcaagatccctttttcggcccaagatgagaaaggagtgacccagaatgggagattgataacagccaaccccatagtcactgacaaagaaaaaccagtcaacattgagacagaaccaccttttggtgagagctacatcgtggtaggggcaggtgaaaaagctttgaaactgagctggttcaagaaagggagcagcatagggaaaatgttcgaagcaactgcccgaggagcacgaaggatggctatcctgggagacaccgcatgggactttggctctataggaggagtgttcacatcagtgggaaaattggtacaccaggtttttggagccgcatatggggttctgttcagcggtgtttcttggaccatgaaaataggaatagggattctgctgacatggttgggattaaattcaaggagcacgtcactttcgatgacgtgcattgcggttggcatggtcacactgtacctaggagtcatggttcaagcggactcgggatgtgtaatcaactggaagggcagagaactcaaatgtggaagtggtatttttgtcactaatgaagtccacacttggacagagcaatacaaattccaggctgactccccaaaaagactgtcagcagccattgggaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgattaggccacaacccatggaacatagatactcatggaaaagctggggaaaagccaaaatcataggagcagacatacagaatagcaccttcatcatcgacggcccagatactccagaatgccccgatgaccaaagagcgtggaacatttgggaagttgaagactatgggtttggaattttcacgacaaacatatggctgaaattgcgcgactcctacacccaaatgtgtgaccaccggctaatgtccgctgccatcaaagacagcaaggcagtccatgctgacatggggtactggatagaaagtgaaaagaacgagacctggaagctagcgagagcctccttcatagaagtcaagacatgtatctggccgaaatcccacactctatggagtaatggagttttggaaagtgaaatgataatcccaaagatatatggaggaccaatatctcagcacaactacagaccagggtatttcacacaaacagcagggccatggcacctaggcaagttggaattggattttgacttgtgtgaaggtaccacagttgttgtggatgaacattgtggaaatcgaggcccatctctcagaactacaacagtcacaggaaagataatccatgaatggtgttgcagatcctgcacgttaccccccttacgcttcagaggagaagacggatgttggtatggcatggaaatcagaccagttaaggagaaggaggaaaacctagttaggtcaatggtctctgcagggtcaggagaagtggacagtttttcactagggatactatgcgtatcaataatgattgaagaagtgatgagatccagatggagtagaaagatgctgatgactggaacattggctgttttcctccttcttataatgggacaactgacatggaatgacctgattaggttatgcatcatggttggagctaatgcttcagacaggatggggatgggaacaacgtacctggccttgatggctactttcaaaatgagaccaatgttcgctgttgggctactatttcgcagactaacatccagagaagttcttcttctcacgattggattaagcctggtggcatccgtggagttaccaaattctttggaggagctaggggatggacttgcaatgggtatcatgatgttaaaattattgactgaatttcagccacaccagttatggaccaccttactgtctttgacatttatcaaaacaactctttcattggattatgcatggaggacaatggctatggtgctgtcaatcgtatctctctttcctttatgtctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactccttaaaaatgatgtgccgttggccggcccactaatagctggaggcatgctaatagcatgttatgtcatatccggaagctcagccgatttatcattggagaaagcggctgaggtatcctgggaagaagaagcagaacactctggtacctcacacaacatattagtagaggtccaagatgatggaactatgaaaataaaagatgaagagagggatgacacactcaccatactcctcaaagcaactctgctggcagtctcaggagtgtacccaatgtcaataccagcaactcttttcgtgtggtatttttggcagaaaaagaaacagagatcaggagtgttatgggacacacccagccctccggaagtggaaagagcagttcttgatgatggcatctatagaatcctgcaaagaggactgttgggcaggtcccaagtgggagtgggagttttccaggacggcgtgttccacacaatgtggcacgtcaccaggggagctgtccttatgtaccaagggaagaggttggaaccaagctgggccagtgtcaaaaaggacttgatctcatatggaggaggttggagatttcaaggatcatggaacacgggagaagaggtgcaggtgatagccgttgaaccaggaaaaaatcctaaaaatgtacagacaacgccgggtaccttcaagactcccgaaggcgaagttggagccatagccctagattttaaacccggcacatctggatctcccatcgtgaacagagagggaaaaatagtaggtctttatggaaatggagtggtgacaacaagtggaacctacgtcagtgccattgcccaagctaaaacatcacaagaagggcctctaccagagattgaggaggaggtgtttaagaaaaggaacttaacaataatggacctgcatccaggatcgggaaaaacaagaagatatcttccagccatagtccgtgaggccataaaaaggaaactgcgcacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatctccagtgagagttcccaattacaacatgattatcatggatgaagcacattttaccgatccagccagcatagcggccagagggtacatctcaactcgagtgggtatgggtgaagcagctgcgatctttatgacagccactcccccaggatcggtggaggcctttccacaaagtaatgcagttatccaagatgaggaaagagacattcctgagagatcatggaactcaggctacgactggatcactgattttccaggtaaaacagtctggtttgttccaagcattaagtcaggaaatgacattgctaactgtttaagaaagaacggaaaacgggtgatccaattgagcagaaaaacctttgacactgagtaccagaaaacaagaaacaatgactgggactatgttgtcacaacagacatttccgaaatgggggcaaatttccgggccgacagggtaatagacccaaggcggtgcttgaaaccagtgatactaaaagatggtccagagcgtgtcattctagccggaccgatgccagtgactgtggccagtgctgcccagagaagaggaagaattggaaggaaccaaaacaaggaaggtgatcagtacgtttatatgggacagcctttaaataatgatgaggatcacgctcattggacagaagcaaaaatgctccttgacaatataaacacaccagaagggatcattccagccctctttgagccagagagagaaaagagtgcagcaatagatggggagtacagactgcggggagaagcaaggaaaacgttcgtggagctcatgagaagaggagatctaccagtttggctatcctacaaagttgcctcagaaggtttccagtactccgacagaaggtggtgctttgacggggaaaggaacaaccaggtgttggaggagaacatggacgtggagatctggacaaaggaaggagaaaggaagaaattgcgaccccgctggttggatgccagaacatactctgatccactggcccttcgtgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgctatggaggaactaccagacaccatagaaacattgatgctcctagctttgatagctgtgctgactggtggagtgacgctgttcttcctatcaggaaaaggtctagggaaaacatccattggcctgctctgtgtgatggcctcaagcgcactgttatggatggccaatgtggagccacattggatagcggcctccatcatactagagttctttctgatggtgctgctcattccagagccagacagacagcgcactccacaggacaaccagctagcatacgtggtgataggtttgttattcatgatactgacagtggcagccaatgagatgggattattggaaaccacaaagaaagacctggggattggccatgtagccgccgaaaaccaacaccatgccacgatgctggacgtagacctacgcccagcttcagcctggaccctctatgcagtagccacaacagttatcactcccatgatgagacacacaattgaaaacacaacagcaaacatttccctgacagccattgcaaaccaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagttaggccaaataatgttactgatactttgtacatcacagattctcttgatgcggaccacatgggccctgtgtgaatccatcacactggctactggacccttgaccactctctgggagggatctccaggaaaattctggaataccacgatagcagtgtccatggcaaacatcttcaggggaagttatctagcaggagcaggtctggccttctcgttaatgaaatctttgggaggaggcaggagaggtacgggggctcaaggagaaacactgggagagaaatggaaaagacagttaaaccaactgagcaagtcagaattcaacacctacaaaaggagtgggattatggaggtggacagatccgaagccaaagagggattaaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtcaagggatacacaaaaggaggacctggacatgaggaacctatcccaatggcgacctatggatggaacctagtaaagctatactctggaaaagatgtattttttacaccacctgagaaatgtgatacccttctgtgtgatataggagagtcctctccgaatccaactatagaagaaggaagaacgttacgtgttctaaagatggtagaaccatggctcagaggaaaccaattctgcataaaaattctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatgactcacaggaagccaacatatgaaagagacgtggacttaggcgctggaacaagacatgtggcagtggaaccagaggtagccaacctagatattattggccagaggatagagaatataaaaaatgaacacaagtcaacatggcattatgatgaagacaatccatacaaaacatgggcctatcatggatcatatgaggtcaaaccatcaggatcagcctcatctatggtgaatggcgtggtgagattgctcacaaaaccatgggatgtcatccccatggtcacacaaatagccatgaccgataccacacccttcggacaacagagagtgtttaaagagaaagtagatacgcgcacgccgagagcaaaacgaggcacagcacaaattatggaggtgacagccaagtggctatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggaacttcataaacagggaaaatgtgccacgtgtgtctacaacatgatggggaagagagagaaaaaattgggagagtttggaaaggcaaaaggaagtcgtgcaatatggtacatgtggctgggagcacgctttctagagttcgaagcccttggtttcatgaatgaagatcactggttcagtagagagaattcattcagtggagtggaaggagaaggactgcacaaacttggatacatactcagagacatatcaaagatcccggggggaaacatgtatgcagatgacacagccggatgggacacaagaataacagaggatgatcttcagaatgaggctaaaatcactgacatcatggagcctgaacacgctctattagctacgtcaatttttaagctgacctaccaaaacaaggtggtaagggtgcaaagaccagcaaaaaatggaaccgtgatggatgttatatccagacgagaccagagaggaagtgggcaggtcggaacctatggcttaaatactttcaccaatatggaggtccaactaataagacaaatggagtctgaaggaatctttttacccagcgaattggaaacccccaatctagctgagagagttcttgactggttggaaaaacatggcactgaaaggctgaaaagaatggcaattagcggagatgattgtgtggtgaaaccagttgatgacaggtttgcaacagccttaatagctctgaatgacatgggaaaagtaagaaaagacataccgcagtgggaaccttcaaaaggatggaatgactggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctaagactagcggctaatgctatctgttcagctgtcccagttgactgggttccaaccagccgcacaacctggtcaatccatgctcaccatcaatggatgacaacagaagatatgttatcagtgtggaatagggtttggatagaggaaaacccatggatggaggataaaactcatgtatccagctgggaagaagtcccatacttagggaaaagggaagatcaatggtgtggatccctgataggcttgacagcgagggccacttgggccactaacatacaagtagccataaaccaagtgagaaggctcatcggaaatgagaattatctagattacatgacatcaatgaagagattcaagaatgagagtgatcccgaaggggcactctggtaa

SEQ ID NO: 5590 - RNA, 9879 nt, synthetic construct
  misc_feature 1..9879: note = derived and/or modified CDS sequence (wt) from DENV-1__FJ478457__SS-prME
  source 1..9879: mol_type = other RNA
tccgtgaccatgctcctcatgctgctgcccacagccctggcgttccatttgaccacacgagggggagagccacacatgatagttagtaagcaggaaagaggaaagtcactcttgtttaagacctctgcaggtgtcaacatgtgcactctcattgcgatggatttgggagagttatgtgaggacacaatgacctacaaatgccccaggatcactgaggcggaaccagatgacgttgactgctggtgcaatgccacagacacatgggtgacctatgggacgtgttctcaaaccggtgaacaccgacgagacaaacgttccgtggcactggccccacacgtaggacttggtctagaaacaagaaccgaaacatggatgtcctctgaaggcgcctggaaacaaatacaaaaagtggagacttgggctttgagacacccaggattcacggtgatagccctttttctagcacatgccataggaacatccatcactcagaaagggatcattttcattttgctgatgctggtaacaccatcaatggccatgcgatgcgtgggaataggcaacagagacttcgttgaaggactgtcaggagcaacgtgggtggacgtggtattggagcatggaagctgtgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgacgaacgtttgtggatagaggctggggtaatggctgcggactatttggaaaaggaagcctactgacgtgtgctaagttcaagtgtgtgacaaaactggaaggaaagatagttcaacatgaaaatttaaaatattcagtgatagtcactgtccacactggggaccagcaccaggtgggaaacgagactacagaacatggaacaattgcaaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacttggaacagacaagatttgctggtcacattcaagacagctcatgcaaagaaacaggaagtagtcgtactgggatcacaagaaggagcaatgcacactgcgttgactggagcgacagaaatccagacgtcaggaacgacaacaatctttgcagggcatctgaaatgcagactaaaaatggacaaactgactttaaaagggatgtcatatgtgatgtgcacaggctcatttaagctagagaaggaagtggctgagacccagcatggaactgtcctagtgcaggttaaatacgaaggaacagatgcgccatgcaagatccccttttcgacccaagatgagaaaggagtgacccagaatgggagattgataacagccaatcccatagtcactgacaaagaaaaaccagtcaacattgagacagaaccaccttttggtgagagctacatcgtggtaggggcaggtgaaaaagctttgaaactaagctggttcaagaaaggaagcagcatagggaaaatgttcgaagcaaccgcccgaggagcacgaaggatggctatactgggagacaccgcatgggacttcggctctataggaggaatgttcacgtctgtgggaaaattggtacaccaggtttttggaaccgcatatggggttttgttcagcggtgtttcttggaccatgaaaataggaatagggattctgctgacatggttgggattaaattcaaggagcacgtcactttcgatgacgtgcattgcagttggcatggttacactgtacttaggagtcatggttcaagcggactcgggatgtgtaatcaactggaagggcagagaactcaaatgtggaagtggcattttcgtcactaatgaagtccacacttggacagagcaatacaaattccaggctgattccccaaagagactttcagcagccattgggaaggcatgggaggagggcgtgtgtggaattcggtcagccacgcgtcttgagaacatcatgtggaagcaaatatcaaatgaattgaaccacattctacttgagaatgacatgaaattcacagtggttgtaggagatgctagtggaattttggcccaaggaaaaaaaatgatcaggccacaacccatggaacacaaatactcatggaaaagctggggaaaagccaaaatcataggagcagacatacagaacaccacttttatcatcgacggcccagatactccagaatgctccgatgaccaaagagcatggaacatttgggaagtcgaggactatgggtttggaattttcacgacaaacatatggctgaaattgcgtgactcctacacccaaatgtgtgaccaccggttaatgtcagctgccatcaaggacagcaaggcagtccatgctgacatggggtactggatagaaagtgaaaagaacgagacctggaagctagcgagagcttccttcatagaagtcaagacatgcatctggccgaaatctcacactctatggagtaatggagttttggaaagtgaaatgataatcccaaagatatatggaggaccaatatctcagcacaactacagaccagggtatttcacacaaacagcagggccatggcacctaggcaagttggaattggattttgacctgtgtgaaggcaccacagttattgtggatgaacattgtggaaatcgaggtccatctctcagaaccacaacagtcacaggaaagataatccatgaatggtgttgcagatcctgcacgttaccccccttacgcttcagaggagaagacggatgttggtatggcatggaaatcagaccagttaaggagaaggaggagaacctagttaggtcaatggtctctgcagggtcaggagaagtggacagtttttcattgggaatactatgcgtatcaataatgattgaagaagtgatgagatccagatggagtagaaagatgctgatgactggaacactggctgtttttctccttcttataatgggacaactgacatggaatgatctgattaggctatgcatcatggttggagctaatgcttcagacaggatggggatgggaacaacgtacctagccttgatggctactttcaaaatgagaccaatgttcgctgttgggctattatttcgcagactaacatccagagaagttctccttctcacgattggattaagcctggtggcatccgtggagctaccaaattctttggaggagctaggggatggacttgcaatgggtatcatgatgttaaaattattgactgaatttcagccacaccagctatggaccaccttactgtctctgacgtttatcaaaacaactctttcattggattatgcatggaagacaatggctatggcactgtcaatcgtatctctctttcctttatgtctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactcctaaaaaatgatgtgccgttagccggcccactaatagctggaggcatgttaatagcatgttatgtcatatccggaagctcagccgatttatcattggagaaagcggctgaggtatcctgggaagaagaagcagaacactctggtacctcacacaacatgttagtagaggtccaagatgatggaactatgaaaataaaagatgaagagagggatgacacactcaccatactcctcaaagcaactctgctggcagtctcaggagtgtacccaatgtcaataccagcaactctttttgtttggtatttttggcagaaaaagaaacagagatcaggagtgttatgggacacacccagccctccagaagtggaaagagcagttcttgatgatggcatctatagaatcttgcaaagaggactgttgggcaggtcccaagtgggagtgggagttttccaagacggcgtgttccacacaatgtggcacgtcaccaggggagctgtccttatgtaccaagggaagaggctggaaccaagctgggccagtgtaaaaaaggacttgatctcatatggaggaggttggaggtttcaaggatcatggaacactggagaagaagtgcaggtgatagctgttgaaccaggaaaaaaccccaaaaatgtacagacaacgccgggtaccttcaagactcccgaaggcgaagttggggccatagctctagattttaagcccggcacatctggatctcccatcgtgaacagagagggaaaaatagtaggtctctatggaaatggagtggtgacaacaagtggaacctacgtcagtgccattgcccaagctaaagcatcacaagaagggcctctaccagagattgaggatgaggtgtttaggaaaagaaacttaacaataatggacctgcatccaggatcaggaaaaacaagaagatatcttccagccatagtccgtgaggccataaaaaggaaactgcgcacgttaatcttggcccccacaagagttgtcgcctctgaaatggcagaggcactcaagggaatgccaataagatatcagacaacagcagtgaagagtgaacacacaggaagggagatagttgacctcatgtgccacgccacttttaccatgcgtctcttatctccagtgagagttcctaattacaacatgattatcatggatgaagcacatttcaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggcaaaacagtctggtttgtcccaagcatcaaatcaggaaatgacattgccaactgtttaagaaagaacggaaaacgggtgatccaattgagcagaaaaacctttgacactgagtaccagaaaacaaaaaacaatgactgggattatgttgtcacaacagacatttccgaaatgggggcaaatttccgggccgatagggtaatagacccaaggcggtgcttgaaaccggtaatactaaaagatggtccagagcgcgtcattctagccggaccgatgccagtgactgtggccagtgctgctcagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctataaagttgcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccactggccctgcgcgagtttaaagagtttgcagcaggaagaagaagtgtctcaggtgacctaatattggaaatagggaaacttccacaacatttgacgctaagagcccagaatgccctggataacttggtcatgttgcacaattccgaacaaggaggaaaagcctatagacatgctatggaggaactaccagacaccatagaaacattgatgctcttagctttgatagctgtgctgactggtggagtgacgctgttcttcctatcaggaaaaggtctagggaaaacatccattggcctgctctgtgtgatggcctcaagcgcactgttatggatggccagtgtggagccccattggatagcggcctccatcatactagagttctttctgatggtgctgctcattccagagccagacagacagcgcactccacaggacaaccagctagcatatgtggtgataggtttgttattcatgatactgacagtggcagccaatgagatgggattattggaaactacaaagaaagacctggggattggccatgtagccgccgaaaaccaccaccatgctacaatgctggacgtagacctacgtccagcttcagcctggaccctctatgcagtagccacaacagttatcactcccatgatgagacacacaattgaaaatacaacggcaaacatttccctgacagccattgcaaatcaggcagctatattgatgggacttgataagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaagaacagcggccggaataatgaaaaatccaaccgtagatgggattgttgcaatagacttggatcctgtggtttatgatgcaaaatttgaaaaacagctaggccaaataatgttactgatactttgcacatcacagattctcttgatgcggaccacatgggccttgtgtgaatccatcacactggctactggacccttgaccacactctgggagggatccccaggaaaattctggaataccacgatagcagtgtccatggcaaacatcttcaggggaagttatctagcaggagcaggtctggccttctcattaatgaaatctttaggaggaggtaggagaggtacgggagctcaaggggaaacactgggagagaaatggaaaagacagctaaaccaactgagcaagtcagaattcaacacctacaaaaggagtgggattatggaggtggacagatccgaagccaaagagggattgaaaagaggagaaacaaccaaacatgcagtgtcgagaggaacagccaaactgaggtggtttgtggagaggaacctcgtgaaaccagaagggaaagtcatagacctcggttgtgggagaggtggctggtcatattattgtgctgggttgaagaaggtcactgaagtgaagggatacacaaaaggaggacctggacatgaggaacccatcccaatggcgacctatggatggaacctagtaaagctacactctggaaaagatgtattttttacaccacctgagaaatgtgatacccttctgtgtgatattggtgagtcctctccgaatccaactatagaagaaggaagaacgttacgtgttctaaagatggtggaaccatggctcagaggaaaccaattctgtataaaaatcctaaatccttacatgccaagtgtggtagaaactctggagcaaatgcaaagaaaacatggagggatgctagtgaggaacccactctcaagaaattccacccatgaaatgtactgggtttcatgtggaacaggaaacattgtgtcggcagtgaacatgacatccagaatgttactgaatcgattcacaatggctcataggaagccaacatatgaaagagacgttgacttaggcgctggaacaagacatgtggcagtggaaccagaggtagccaacctagatatcattggccagaggatagagaacataaaaaatgaacacaagtcaacatggcattatgatgaagacaatccatacaaaacatgggcctatcatggatcatatgaggtcaagccatcaggatcagcctcatctatggtgaatggcgtggtaagattgctcacaaaaccatgggatgttatccccatggtcacacaaatagctatgactgatactacacccttcggacaacagagagtgtttaaagagaaagttgacacgcgcacaccaagagcaaaacgaggcacagcacaagttatggaagtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaagttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttttagagttcgaggcccttggtttcatgaatgaagatcactggttcagtagagagaattcactcagtggagtggaaggagaaggactgcacaaacttggatatatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacctaccaaaacaaggtggtgagggtgcagagaccagcaaaaaatggaaccgtgatggatgtcatatccagacgtgaccagagaggaagtggacaggtcggaacttatggcttaaatactttcaccaacatggaggtccaactaataagacagatggagtctgaaggaatctttttacccagcgaattggaaaccccaaatctagctgagagagttcttgactggttggaaaaacatggcaccgaaaggctgaaaagaatggcaattagcggagatgattgtgtggtgaaaccaattgatgacaggttcgcaacagccttaatagctctgaatgacatggggaaagtaagaaaagacataccgcagtgggaaccttcaaaaggatggaatgaatggcagcaagtgcctttctgttcacaccatttccaccagctgatcatgaaggatgggagggaaatagtggtgccatgccgcaaccaagatgaacttgtgggcagggccagagtatcacaaggcgccggatggagcctgagagaaactgcttgcctaggcaagtcatacgcacaaatgtggcagctgatgtacttccacaggagagacctgagactagcggctaatgccatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagaccaatggtgtggatccctgataggcttgacagcgagggccacctgggccaccaacatacaagtagccataaaccaagtgagaaggctcatcgggaatgagaattatctagattacatgacatcaatgaagagatttaagaatgagagtgatcccgaaggggcactctggtaa

SEQ ID NO: 5591 - RNA, 9879 nt, synthetic construct
  misc_feature 1..9879: note = derived and/or modified CDS sequence (wt) from DENV-1__FJ410188__SS-prME
  source 1..9879: mol_type = other RNA
tccgtgaccatgctcctcatgctgctgcccacagtcctggcgttccatttgaccacacgagggggagagccacacatgatagttagtaagcaggaaagaggaaagtcactcttgtttaagacctctgcaggtgtcaacatgtgcactctcattgcgatggatttgggagagttatgtgaggacacaatgacctacaaatgccccaggatcactgaggcggaaccagatgacgttgactgctggtgcaatgccacagacacatgggtgacctatgggacgtgttctcaaaccggtgaacaccgacgagacaaacgttccgtggcactggccccacacgtaggacttggtctagaaacaagaactgaaacatggatgtcctctgaaggcgcctggaaacaaatacaaaaagtggagacttgggctttgagacatccaggattcacggtgatagctctttttctagcacatgccataggaacatccatcactcagaaagggatcattttcattttgctgatgctggtaacaccatcaatggccatgcgatgcgtgggaataggcaacagagacttcgttgaaggactgtcaggagcaacgtgggtggacgtggtattggagcatggaagctgtgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgacgaacgtttgtggatagaggctggggtaatggctgcggactatttggaaaaggaagcctactgacgtgtgctaagttcaagtgtgtgacaaaactggaaggaaagatagttcaacatgaaaatttaaaatattcagtgatagtcactgtccacactggggaccagcaccaggtgggaaacgagactacagaacatggaacaattgcaaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacttggaacagacaagatttgctggtcacattcaagacagctcatgcaaagaaacaggaagtagtcgtactgggatcacaagaaggagcaatgcacactgcgttgactggagcgacagaaatccagacgtcaggaacgacaacaatctttgcagggcatctgaaatgcagactaaaaatggacaaactgactttaaaagggatgtcatatgtgatgtgcacaggctcatttaagctagagaaggaagtggctgagacccagcatggaactgtcctagtgcaggttaaatacgaaggaacagatgcgccatgcaagatccccttttcgacccaagatgagaaaggagtgacccagaatgggagattgataacagccaatcccatagtcactgacaaagaaaaaccagtcaacattgagacagaaccaccttttggtgagagctacatcgtggtaggggcaggtgaaaaagctttgaaactaagctggttcaagaaaggaagcagcatagggaaaatgttcgaagcaaccgcccgaggagcacgaaggatggctatactgggagacaccgcatgggacttcggctctataggaggaatgttcacgtctgtgggaaaattggtacaccaggtttttggaaccgcatatggggttttgttcagcggtgtttcttggaccatgaaaataggaatagggattctgctgacatggttgggattaaattcaaggagcacgtcactttcgatgacgtgcattgcagttggcatggttacactgtacttaggagtcatggttcaagcggactcgggatgtgtaatcaactggaagggcagagaactcaaatgtggaagtggcattttcgtcactaatgaagtccacacttggacagagcaatacaaattccaggctgattccccaaagagactttcagcagccattgggaaggcatgggaggagggcgtgtgtggaattcgatcagccacgcgtcttgagaacatcatgtggaagcaaatatcaaatgaattgaaccacattctacttgagaatgacatgaaattcacagtggttgtaggagatgctagtggaattttggcccaaggaaaaaaaatgatcaggccacaacccatggaacacaaatactcatggaaaagctggggaaaagccaaaatcataggagcagacatacagaacaccacttttatcatcgacggcccagatactccagaatgctccgatgaccaaagagcatggaacatttgggaagtcgaggactatgggtttggaattttcacgacaaacatatggctgaaattgcgtgactcctacacccaaatgtgtgaccaccggttaatgtcagctgccatcaaggacagcaaggcagtccatgctgacatggggtactggatagaaagtgaaaagaacgagacctggaagctagcgagagcttccttcatagaagtcaagacatgcatctggccgaaatctcacactctatggagtaatggagttttggaaagtgaaatgataatcccaaagatatatggaggaccaatatctcagcacaactacagaccagggtatttcacacaaacagcagggccatggcacctaggcaagttggaattggattttgacctgtgtgaaggcaccacagttattgtggatgaacattgtggaaatcgaggtccatctctcagaaccacaacagtcacaggaaagataatccatgaatggtgttgcagatcctgcacgttaccccccttacgcttcagaggagaagacggatgttggtatggcatggaaatcagaccagttaaggagaaggaggagaacctagttaggtcaatggtctctgcagggtcaggagaagtggacagtttttcattgggaatactatgcgtatcaataatgattgaagaagtgatgagatccagatggagtagaaagatgctgatgactggaacactggctgtttttctccttcttataatgggacaactgacatggaatgatctgattaggctatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcctggtggcatccgtggagctaccaaattctttggaggagctaggggatggacttgcaatgggtatcatgatgttaaaattattgactgaatttcagccacaccagctatggaccaccttactgtctctgacgtttatcaaaacaactctttcattggattatgcatggaagacaatggctatggcactgtcaatcgtatctctctttcctttatgtctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactcctaaaaaatgatgtgccgttagccggcccactaatagctggaggcatgttaatagcatgttatgtcatatccggaagctcagccgatttatcattggagaaagcggctgaggtatcctgggaagaagaagcagaacactctggtacctcacacaacatgttagtagaggtccaagatgatggaactatgaaaataaaagatgaagagagggatgacacactcaccatactcctcaaagcaactctgctggcagtctcaggagtgtacccaatgtcaataccagcaactctttttgtgtggtatttttggcagaaaaagaaacagagatcaggagtgttatgggacacacccagccctccagaagtggaaagagcagttcttgatgatggcatctatagaatcttgcaaagaggactgttgggcaggtcccaagtgggagtgggagttttccaagacggcgtgttccacacaatgtggcacgtcaccaggggagctgtccttatgtaccaagggaagaggctggaaccaagctgggccagtgtaaaaaaggacttgatctcatatggaggaggttggaggtttcaaggatcatggaacactggagaagaagtgcaggtgatagctgttgaaccaggaaaaaaccccaaaaatgtacagacaacgccgggtaccttcaagactcccgaaggcgaagttggagccatagctctagattttaagcccggcacatctggatctcccatcgtgaacagagagggaaaaatagtaggtctctatggaaatggagtggtgacaacaagtggaacctacgtcagtgccattgcccaagctaaagcatcacaagaagggcctctaccagagattgaggatgaggtgtttaggaaaagaaacttaacaataatggacctgcatccaggatcaggaaaaacaagaagatatcttccagccatagtccgtgaggccataaaaaggaaactgcgcacgttaatcttggcccccacaagagttgtcgcctctgaaatggcagaggcactcaagggaatgccaataagatatcagacaacagcagtgaagagtgaacacacaggaagggagatagttgacctcatgtgccacgccacttttaccatgcgtctcttatctccagtgagagttcctaattacaacatgattatcatggatgaagcacatttcaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggcaaaacagtctggtttgtcccaagcatcaaatcaggaaatgacattgccaactgtttaagaaagaacggaaaacgggtgatccaattgagcagaaaaacctttgacactgagtaccagaaaacaaaaaacaatgactgggattatgttgtcacaacagacatttccgaaatgggagcaaatttccgggccgatagggtaatagacccaaggcggtgcttgaaaccggtaatactaaaagatggtccagagcgcgtcattctagccggaccgatgccagtgactgtggccagtgctgctcagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagcgcagcaatagacggggagtacagactgcggggagaagcaaggaaaacgttcgtggagctcatgagaagaggagatctaccagtttggctatcctacaaagttgcctcagaaggttttcagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccactggccctgcgcgagttcaaagagtttgcagcaggaagaagaagtgtctcaggtgacctaatcttggaaatagggaaacttccacaacatttgacgctaagagcccagaatgctttggataacttggtcatgttgcacaattccgaacaaggaggaaaagcctatagacatgctatggaggaactaccagacaccatagaaacattgatgctcttagctttgatagctgtgctgactggtggagtgacgctgttcttcctatcaggaaaaggtctagggaaaacatccattggcctgctctgtgtgatggcctcaagcgcactgttatggatggccagtgtggagccccattggatagcggcctccatcatactagagttctttctgatggtgctgctcattccagagccagacagacagcgcactccacaggacaaccagctagcatatgtagtgataggtttgttattcatgatactgacagtggcagccaatgagatgggattattggaaactacaaagaaagacctggggattggccatgtagccgccgaaaaccaccaccatgctacaatgctggacgtagacctacgtccagcttcagcctggaccctctatgcggtagccacaacagttatcactcccatgatgagacacacaattgaaaatacaacagcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgctgatgttagtggctcattatgccataattggaccaggactgcaagcaaaggccactagagaagctcaaaaaaggacagcggccggaataatgaaaaatccaaccgtagatgggattgttgcaatagatttggatcctgtggtttatgatgcaaaatttgaaaaacagctaggccaaataatgttactgatactttgcacatcacagattctcttgatgcggaccacatgggccttgtgtgaatccatcacactggctactggacccttgaccactctctgggagggatctccaggaaaattctggaataccacgatagcagtgtccatggcaaacatcttcaggggaagttatctagcaggagcaggtctggccttctcattaatgaaatctttaggaggaggtaggagaggtacgggagctcaaggggaaacactgggagagaaatggaaaagacagctaaaccaactgagcaagtcagaattcaacacctacaaaaggagtgggattatggaggtggacagatccgaagccaaagagggattgaaaagaggagaaacaaccaaacatgcagtgtcgagaggaacagccaaactgaggtggtttgtggagaggaacctcgtgaaaccagaagggaaagtcatagatctcggttgtgggagaggtggctggtcatattattgtgctgggctgaagaaggtcactgaagtgaagggatacacaaaaggaggacctggacatgaggaacccatcccaatggcgacctatggatggaacctagtaaagctacactctggaaaagatgtattttttacaccacctgagaaatgtgatacccttctgtgtgatattggtgagtcctctccgaatccaactatagaagaaggaagaacgttacgtgttctaaagatggtggaaccatggctcagaggaaaccaattctgtataaaaatcctaaatccttacatgccaagtgtggtagaaactctggagcaaatgcaaagaaaacatggagggatgctagtgaggaacccactctcaagaaattccacccatgaaatgtactgggtttcatgtggaacaggaaacattgtgtcggcagtgaacatgacatccagaatgttactgaatcgattcacaatggctcataggaagccaacatatgaaagagacgttgacttaggcgctggaacaagacatgtggcagtggaaccagaggtagccaacctagatatcattggccagaggatagagaacataaaaaatgaacacaagtcaacatggcattatgatgaagacaatccatacaaaacatgggcctatcatggatcatatgaggtcaagccatcaggatcagcctcatctatggtgaatggcgtggtaagattgctcacaaaaccatgggatgttatccccatggtcacacaaatagctatgactgatactacacccttcggacaacagagagtgtttaaagagaaagttgacacgcgcacaccaagagcaaaacgaggcacagcacaagttatggaagtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaagttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttttagagttcgaggcccttggtttcatgaatgaagatcactggttcagtagagagaattcactcagtggagtggaaggagaaggactgcacaaacttggatatatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacctaccaaaacaaggtggtgagggtgcagagaccagcaaaaaatggaaccgtgatggatgtcatatccagacgtgaccagagaggaagtggacaggtcggaacttatggcttaaatactttcaccaacatggaggtccaactaataagacagatggagtctgaaggaatctttttacccagcgaattggaaaccccaaatctagctgagagagttcttgactggttggaaaaacatggcaccgaaaggctgaaaagaatggcaattagcggagatgattgtgtggtgaaaccaattgatgacaggttcgcaacagccttaatagctctgaatgacatggggaaagtaagaaaagacataccgcagtgggaaccttcaaaaggatggaatgaatggcagcaagtgcctttctgttcacaccatttccaccagctgatcatgaaggatgggagggaaatagtggtgccatgccgcaaccaagatgaacttgtgggcagggccagagtatcacaaggcgccggatggagcctgagagaaactgcttgcctaggcaagtcatacgcacaaatgtggcagctgatgtacttccacaggagagacctgagactagcggctaatgccatctgttcagccgtcccagttgattgggtcccaaccagccgcacaacctggtcaatccatgcccaccaccaatggatgacaacagaagacatgttatcagtgtggaatagggtctggatagaggaaaacccatggatggaggacaaaactcatgtatccagttgggaagaagttccatacctagggaaaagggaagatcaatggtgtggatctctgataggcttgacagcgagggccacctgggccaccaacatacaagtagccataaaccaagtgagaaggctcatcgggaatgagaattatctagattacatgacatcaatgaagagattcaagaatgagagtgatcccgaaggggcactctggtaa

SEQ ID NO: 5592 - RNA, 9879 nt, synthetic construct
  misc_feature 1..9879: note = derived and/or modified CDS sequence (wt) from DENV-1__FJ478458__SS-prME
  source 1..9879: mol_type = other RNA
tctgtgaccatgctcctcatgctgctgcccacagccctggcgttccatttgaccacacgagggggagagccacacatgatagttagtaagcaggaaagaggaaagtcactgttgtttaagacctctgcaggcatcaatatgtgcactctcattgcgatggatttgggagagttatgcgaggacacaatgacctacaaatgcccccggatcactgaggcggaaccagatgacgttgactgctggtgcaatgccacagacacatgggtgacctatgggacatgttctcaaaccggcgaacaccgacgagacaaacgttccgtggcactggccccacacgtgggacttggtctagaaacaagaacggaaacatggatgtcctctgaaggtgcctggaaacaaatacaaaaagtggagacttgggctttgagacacccaggattcacggtgacagccctttttttagcacatgccataggaacatccattactcagaaagggatcattttcattttgctgatgctagtaacaccatcaatggccatgcgatgtgtgggaataggcaacagagacttcgttgaaggactgtcaggagcaacgtgggtggacgtggtattggagcatggaagctgcgtcaccaccatggcaaaagataaaccaacattggacattgaactcttgaagacggaggtcacaaaccctgccatcttgcgcaaactgtgcattgaagctaaaatatcaaacaccaccaccgattcaaggtgtccaacacaaggagaggccacactggtggaagaacaagactcgaactttgtgtgtcgacgaacgtttgtggacagaggctggggtaatggctgcggactatttggaaaaggaagcctactgacgtgtgctaagttcaagtgtgtgacaaaactagaaggaaagatagttcaatatgaaaacttaaaatattcagtgatagtcactgtccacactggggaccagcaccaggtgggaaacgagactacagaacatggaacaattgcaactataacacctcaagctcctacgtcggaaatacagctgactgactacggagccctcacattggactgctcacctagaacagggctggactttaatgagatggttctattgacaatgaaagaaaaatcatggcttgtccacaaacaatggtttctagacttaccactgccttggacttcaggagcttcaacatctcaagagacttggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacacctgaaatgcagactaaaaatggataaactgactttaaaagggatgtcatatgtaatgtgcacaggctcatttaagctagagaaggaagtggctgagacccagcatggaactgttctagtgcaggttaaatacgaaggaacagatgcgccatgcaagatccctttttcggcccaagatgagaaaggagtgacccagaatgggagattgataacagccaaccccatagtcactgacaaagaaaaaccagtcaacattgagacagaaccaccttttggtgagagctacatcgtggtaggggcaggtgaaaaagctttgaaactgagctggttcaagaaagggagcagcatagggaaaatgttcgaagcaactgcccgaggagcacgaaggatggctatcctgggagacaccgcatgggactttggctctataggaggagtgttcacatcagtgggaaaattggtacaccaggtttttggagccgcatatggggttctgttcagcggtgtttcttggaccatgaaaataggaatagggattctgctgacatggttgggattaaattcaaggagcacgtcactttcgatgacgtgcattgcggttggcatggtcacactgtacctaggagtcatggttcaagcggactcgggatgtgtaatcaactggaagggcagagaactcaaatgtggaagtggtatttttgtcactaatgaagtccacacttggacagagcaatacaaattccaggctgactccccaaaaagactgtcagcagccattgggaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgattaggccacaacccatggaacatagatactcatggaaaagctggggaaaagccaaaatcataggagcagacatacagaataccaccttcatcatcgacggcccagatactccagaatgccccgatgaccaaagagcgtggaacatttgggaagttgaagactatgggtttggaattttcacgacaaacatatggctgaaattgcgcgactcctacacccaaatgtgtgaccaccggctaatgtccgctgccatcaaagacagcaaggcagtccatgctgacatggggtactggatagaaagtgaaaagaacgagacctggaagctagcgagagcctccttcatagaagtcaagacatgtatctggccaaaatcccacactctatggagtaatggagttttggaaagtgaaatgataatcccaaagatatatggaggaccaatatctcagcacaactacagaccagggtatttcacacaaacagcagggccatggcacctaggcaagttggaattggattttgacttgtgtgaaggtaccacagttgttgtggatgaacattgtggaaatcgaggcccatctctcagaactacaacagtcacaggaaagataatccatgaatggtgttgcagatcctgcacgttaccccccttacgcttcagaggagaagacggatgttggtatggcatggaaatcagaccagttaaggagaaggaggaaaacctagttaggtcaatggtctctgcagggtcaggagaagtggacagtttttcactagggatactatgcgtatcaataatgattgaagaagtgatgagatccagatggagtagaaagatgctgatgactggaacattggctgttttcctccttcttataatgggacaactgacatggaatgacctgattaggttatgcatcatggttggagctaatgcttcagacaggatggggatgggaacaacgtacctggccttgatggctactttcaaaatgagaccaatgttcgctgttgggctactatttcgcagactaacatccagagaagttcttcttctcacgattggattaagcctggtggcatccgtggagttaccaaattctttggaggagctaggggatggacttgcaatgggtatcatgatgttaaaattattgactgaatttcagccacaccagttatggaccaccttactgtctttgacatttatcaaaacaactctttcattggattatgcatggaggacaatggctatggtgctgtcaatcgcatctctctttcctttatgtctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactccttaaaaatgatgtgccgttggccggcccactaatagctggaggcatgctaatagcatgttatgtcatatccggaagctcagccgatttatcattggagaaagcggctgaggtatcctgggaagaagaagcagaacactctggtacctcacacaacatattagtagaggtccaagatgatggaactatgaaaataaaagatgaagagagggatgacacactcaccatactcctcaaagcaactctgctggcagtctcaggagtgtacccaatgtcaataccagcaactcttttcgtgtggtatttttggcagaaaaagaaacagagatcaggagtgttatgggacacacccagccctccggaagtggaaagagcagttcttgatgatggcatctatagaatcctgcaaagaggactgttgggcaggtcccaagtgggagtgggagttttccaagacggcgtgttccacacaatgtggcacgtcaccaggggagctgtccttatgtaccaagggaagaggttggaaccaagctgggccagtgtcaaaaaggacttgatctcatatggaggaggttggagatttcaaggatcatggaacacgggagaagaggtgcaggtgatagccgttgaaccaggaaaaaatcccaaaaatgtacagacaacgccgggtaccttcaagactcccgaaggcgaagttggagccatagctctagattttaaacccggcacatctggatctcccatcgtgaacagagagggaaaaatagtaggtctttatggaaatggagtggtgacaacaagtggaacctacgtcagtgccattgcccaagctaaaacatcacaagaagggcctctaccagagattgaggaggaggtgtttaagaaaaggaacttaacaataatggacctgcatccaggatcgggaaaaacaagaagatatcttccagccatagtccgtgaggccataaaaaggaaactgcgcacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatctccagtgagagttcccaattacaacatgattatcatggatgaagcacattttaccgatccagccagcatagcggccagagggtacatctcaactcgagtgggtatgggtgaagcagctgcgatctttatgacagccactcccccaggatcggtggaggcctttccacaaagcaatgcagttatccaagatgaggaaagagacattcctgagagatcatggaactcaggctacgactggatcactgattttccaggtaaaacagtctggtttgttccaagcattaagtcaggaaatgacattgctaactgtttaagaaagaacggaaaacgggtgatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccagtgatactaaaagatggtccagagcgtgtcattctagccggaccgatgccagtgactgtggccagtgctgcccagagaagaggaagaattggaaggaaccaaaacaaggaaggtgatcagtacgtttatatgggacagcctttaaataatgatgaggatcacgctcattggacagaagcaaaaatgctccttgacaatataaacacaccagaagggatcattccagccctctttgagccagagagagaaaagagtgcagcaatagatggggagtacagactgcggggagaagcaaggaaaacgttcgtggagctcatgagaagaggagatctaccagtttggctatcctacaaagttgcctcagaaggtttccagtactccgacagaaggtggtgctttgacggggaaaggaacaaccaggtgttggaggagaacatggacgtggagatctggacaaaggaaggagaaaggaagaaattacgaccccgctggttggatgccagaacatactctgatccactggcccttcgtgagtttaaagaatttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgctatggaggaactaccagacaccatagaaacattgatgctcctagctttgatagctgtgctgactggtggagtgacgctgttcttcctatcaggaaaaggtctagggaaaacatccattggcctgctctgtgtgatggcctcaagcgcactgttatggatggccaatgtggagccacattggatagcggcctccatcatactagagttctttctgatggtgctgctcattccagagccagacagacagcgcactccacaggacaaccagctagcatacgtggtgataggtttgttattcatgatactgacagtggcagccaatgagatgggattattggaaaccacaaagaaagacctggggattggccatgtagccgccgaaaaccaacaccatgccacgatgctggacgtagacctacgcccagcttcagcctggaccctctatgcagtagccacaacagttatcactcccatgatgagacacacaattgaaaacacaacagcaaacatttccctgacagccattgcaaaccaggcagctatattgatgggacttgacaagggatggccaatatcgaagatggacataggagttccacttctcgccttagggtgctattcccaggtgaaccccttgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagttaggccaaataatgttactgatactttgtacatcacagattctcttgatgcggaccacatgggccctgtgtgaatccatcacactggctactggacccttgaccactctctgggagggatctccaggaaaattctggaataccacgatagcagtgtccatggcaaacatcttcaggggaagttatctagcaggagcaggtctggccttctcgttaatgaaatctttgggaggaggcaggagaggtacgggggctcaaggagaaacactgggagagaaatggaaaagacagttaaaccaactgagcaagtcagaattcaacacctacaaaaggagtgggattatggaggtggacagatccgaagccaaagagggattaaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtcaagggatacacaaaaggaggacctggacatgaggaacctatcccaatggcgacctatggatggaacctagtaaagctatactctggaaaagatgtattttttacaccacctgagaaatgtgatacccttctgtgtgatataggagagtcctctccgaatccaactatagaagaaggaagaacgttacgtgttctaaagatggtagaaccatggctcagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatgactcacaggaagccaacatatgaaagagacgtggacttaggcgctggaacaagacatgtggcagtggaaccggaggtagccaacctagatatcattggccagaggatagagaatataaaaaatgaacacaagtcaacatggcattatgatgaagacaatccatacaaaacatgggcctatcatggatcatatgaggtcaaaccatcaggatcagcctcatctatggtgaatggcgtggtgagattgctcacaaaaccatgggatgtcatccccatggtcacacaaatagccatgaccgataccacacccttcggacaacagagagtgtttaaagagaaagtagatacgcgcacgccgagagcaaaacgaggcacagcacaaattatggaggtgacagccaagtggctatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggaacttcataaacagggaaaatgtgccacgtgtgtctacaacatgatggggaagagagagaaaaaattgggagagtttggaaaggcaaaaggaagtcgtgcaatatggtacatgtggctgggagcacgctttctagagttcgaagcccttggtttcatgaatgaagatcactggttcagtagagagaattcattcagtggagtggaaggagaaggactgcacaaacttggatacatactcagagacatatcaaagatcccggggggaaacatgtatgcagatgacacagccggatgggacacaagaataacagaggatgatcttcagaatgaggctaaaatcactgacatcatggagcctgaacacgctctattggctacgtcaatttttaagctgacctaccaaaacaaggtggtaagggtgcaaagaccagcaaaaaatggaaccgtgatggatgttatatccagacgagaccagagaggaagtgggcaggtcggaacctatggcttaaatactttcaccaatatggaggtccaactaataagacaaatggagtctgaaggaatctttttacccagcgaattggaaacccccaatctagctgagagagttcttgactggttggaaaaacatggcactgaaaggctgaaaagaatggcaattagcggagatgattgtgtcgtgaaaccagttgatgacaggtttgcaacagccttaatagctctgaatgacatgggaaaagtaagaaaagacataccgcagtgggaaccttcaaaaggatggaatgactggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctaagactagcggctaatgctatctgttcagctgtcccagttgactgggtcccaaccagccgcacaacctggtcaatccatgctcaccatcaatggatgacaacagaagatatgttatcagtgtggaatagggtttggatagaggaaaacccatggatggaggataaaactcatgtatccagctgggaagaagtcccatacttagggaaaagggaagatcaatggtgtggatccctgataggcttgacagcgagggccacttgggccactaacatacaagtagccataaaccaagtgagaaggctcatcgggaatgagaattatctagattacatgacatcaatgaagagattcaagaatgagagtgatcccgaaggggcactctggtaa

SEQ ID NO: 5593 - RNA, 9879 nt, synthetic construct
  misc_feature 1..9879: note = derived and/or modified CDS sequence (wt) from DENV-1__FJ410190__SS-prME
  source 1..9879: mol_type = other RNA
tctgtgaccatgctcctcatgctgctgcccacagccctggcgttccatttgaccacacgagggggagagccacacatgatagttagtaagcaggaaagaggaaagtcactgttgtttaagacctctgtaggcatcaatatgtgcactctcattgcgatggatttgggagagttatgcgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggacttggtctagaaacaagaaccgaaacatggatgtcctctgaaggtgcctggaaacaaatacaaaaagtggagacttgggctttgagacacccaggattcacggtgatagccctttttttagcacatgccataggaacatccattactcagaaagggatcattttcattttgctgatgctagtaacaccatcaatggccatgcgatgtgtgggaataggcaacagagacttcgttgaaggactgtcaggagcaacgtgggtggacgtggtattggagcatggaagctgcgtcaccaccatggcaaaagataaaccaacattggacattgaactcttgaagacggaggtcacaaaccctgccgtcttgcgcaaactgtgtattgaagctaaaatatcaaacaccaccaccgattcaaggtgtccaacacaaggagaggctacactggtggaagaacaagactcgaactttgtgtgtcgacgaacgtttgtggacagaggctggggtaatggctgcggactatttggaaaaggaagcttactgacgtgtgctaagttcaagtgtgtgacaaaactagaaggaaagatagttcaatatgaaaacttaaaatattcagtgatagtcactgtccacactggggaccagcaccaggtgggaaacgagaccacagaacatggaacaattgcaaccataacacctcaagctcctacgtcggaaatacagctgactgactacggagccctcacattggactgctcgcctagaacagggctggactttaatgagatggttctattgacaatgaaagaaaaatcatggcttgtccacaaacaatggtttctagacttaccactgccttggacttcaggagcttcaacatctcaagagacttggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacacctgaaatgcagactaaaaatggataaattgactttaaaagggatgtcatatgtaatgtgcacaggctcatttaagctagagaaggaagtggctgagacccagcatggaactgttctagtgcaggttaaatacgaaggaacagatgcgccatgcaagatccctttttcggcccaagatgagaagggagtgacccagaatgggagattgataacagccaaccccatagtcactgacaaagaaaaaccagtcaacattgagacagaaccaccttttggtgagagctacatcgtgataggggcaggtgaaaaagctttgaaactgagctggttcaagaaagggagcagcatagggaaaatgttcgaagcaactgcccgaggagcacgaaggatggctatcctgggagacaccgcatgggactttggctctataggaggagtgttcacatcagtgggaaaattggtacaccaggtttttggagccgcatatggggttctgttcagcggtgtttcttggaccatgaaaataggaatagggattctgctgacatggttgggattaaattcaaggagcacgtcactttcgatgacgtgcattgcggttggcatggtcacactgtacctaggagtcatggttcaagcggactcaggatgtgtaatcaactggaagggcagagaactcaaatgtggaagtggtatttttgtcactaatgaagtccacacttggacagagcaatacaaattccaggctgactccccaaaaagactgtcagcagccattgggaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgattaggccacaacccatggaacatagatactcatggaaaagctggggaaaagccaaaatcataggagcagacatacagaataccaccttcatcatcgacggcccagatactccagaatgccccgatgaccaaagagcgtggaacatttgggaagttgaagactatgggtttggaattttcacgacaaacatatggctgaaattgcgcgactcctacacccaaatgtgtgaccaccggctaatgtcagctgccatcaaagacagcaaggcagtccatgctgacatggggtactggatagaaagtgaaaagaacgagacctggaagctagcgagagcctccttcatagaagtcaagacatgtatctggccgaaatcccacactctatggagtaatggagttttggaaagtgaaatgataatcccaaagatatatggaggaccaatatctcaacacaactacagaccagggtatttcacacaaacagcagggccatggcatctaggcaagttggaattggattttgacttgtgtgaaggtaccacagttgttgtggatgaacattgtggaaatcgaggtccatctctcagaactacaacagtcacaggaaagataatccatgaatggtgttgcagatcctgcacgttaccccccttacgcttcagaggagaagacggatgttggtatggcatggaaatcagaccagttaaggagaaggaggaaaacctagttaggtcaatggtctctgcagggtcaggagaagtagacagtttttcactagggatactatgcgtatcaataatgattgaagaagtgatgagatccagatggagtagaaagatgctgatgactggaacattggctgttttcctccttcttataatgggacaactgacatggaatgatctgattaggttatgcatcatggttggagctaatgcttcagacaggatggggatgggaacaacgtacctggccttgatggctactttcaaaatgagaccaatgttcgctgttgggctattatttcgcagactaacatccagagaagttcttcttctcacgattggattaagcctagtggcatccgtggagttaccaaattctttggaggagctaggggatggacttgcaatgggtatcatgatgttaaaattattgactgaatttcagccacaccagttatggaccaccttactgtctttgacatttatcaaaacaactctttcattggattatgcatggaggacaatggctatggtgctgtcaatcgtatctctctttcctttatgtctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactccttaaaaatgatgtgccgttagccggcccactaatagctggaggcatgctaatagcatgttatgtcatatccggaagctcagccgatttatcattggagaaagcggctgaggtatcctgggaagaagaagcagaacactctggtacctcacacaacatattagtagaggtccaagatgatggaactatgaaaataaaagatgaagagagggatgacacactcaccatactcctcaaagcaactctgctggcagtctcaggagtgtacccaatgtcaataccagcaactcttttcgtgtggtatttttggcagaaaaagaaacagagatcaggagtgttatgggacacacccagccctccggaagtggaaagagcagttcttgatgatggcatctatagaatcctgcaaagaggactgttgggcaggtcccaagtaggagtgggagtcttccaagacggcgtgttccacacaatgtggcacgtcaccaggggagctgtccttatgtaccaagggaagaggttagaaccaagctgggccagtgtcaaaaaggacttgatctcatatggaggaggttggagatttcaaggatcatggaacacgggagaagaggtgcaggtgatagctgttgaaccaggaaaaaatcccaaaaatgtacagacaacgccgggtaccttcaagactcccgaaggcgaagttggagccatagctctagattttaaacccggcacatctggatctcccatcgtgaacagagaggaaaaaatagtaggtctttatggaaatggagtggtgacaacaagtggaacctacgtcagtgccattgcccaagctaaaacatcacaagaagggcctctaccagagattgaggacgaggtgtttaagaaaaggaacttaacaataatggacctgcatccaggatcgggaaaaacaagaagatatcttccagccatagtccgtgaggccataaaaaggaaactgcgcacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatctccagtgagagttcccaattacaacatgattatcatggatgaagcacattttaccgatccagccagcatagcggccagagggtacatctcaactcgagtgggtatgggtgaagcagctgcgatctttatgacagccactcccccaggatcggtggaggcctttccacaaagcaatgcagttatccaagatgaggaaagagacattcctgagagatcatggaactcaggctacgactggatcactgattttccaggtaaaacagtctggtttgttccaagcattaagtcaggaaatgacattgctaactgtttaagaaagaacggaaaacgggtgatccagttgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccagtgatactaaaagatggtccagagcgtgtcattctagccggaccgatgccagtgactgtggccagtgctgcccagagaagaggaagaattggaaggaaccaaaacaaggaaggtgatcagtacgtttatatgggacagcctttaaataatgatgaggatcacgctcattggacagaagcaaaaatgctccttgacaatataaacacaccagaagggatcattccagccctctttgagccagagagagaaaagagtgcagcaatagatggggagtacagactgcggggagaagcaaggaaaacgttcgtggagctcatgagaagaggagatctaccagtttggctatcctacaaagttgcctcagaaggtttccagtactccgacagaaggtggtgttttgatggggaaaggaacaaccaagtgttggaggagaacatggacgtggagatctggacaaaggaaggagaaagaaagaaattgcgaccccgctggttggatgccagaacatactctgatccactggcccttcgtgagttcaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgctatggaggaactaccagacaccatagaaacattgatgctcctagctttgatagctgtgctgactggtggagtgacgctgttcttcctatcaggaaaaggtctagggaaaacatccattggcctgctctgtgtgatggcctcaagcgcactgttatggatggccaatgtggagccacattggatagcggcctccatcatactagagttctttctgatggtgctgctcattccagagccagacagacagcgcactccacaggacaaccagctagcatacgtggtgataggtttgttattcatgatactgacagtggcagccaatgagatgggactattggaaaccacaaagaaagacctggggattggccatgtagccgccgaaaaccaacaacatgccacgatgctggacgtagacctacgcccagcttcagcctggaccctctatgcagtagccacaacagttatcactcctatgatgagacacacaattgaaaacacaacggcaaacatttccctgacagccattgcaaaccaggcagccatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagttaggccaaataatgttactgatactttgtacatcacagattctcttgatgcggaccacatgggccttgtgtgaatccatcacactggctactggacccttgaccactctctgggagggatctccaggaaaattctggaataccacgatagcagtgtccatggcaaacatcttcaggggaagttatctagcaggagcaggtctggccttctcgttaatgaaatctttgggaggaggcaggagaggtacgggggctcaaggagaaacactgggagagaaatggaaaagacagttaaaccaactgagcaagtcagaattcaacacctacaaaaggagtgggattatggaggtggacagatccgaagccaaagagggattgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtcaagggatacacaaaaggaggacctggacatgaggaacctatcccaatggcgacctatggatggaacctagtaaagctatactctggaaaagatgtattttttacaccacctgagaaatgtgatacccttctgtgtgatataggagagtcctctccgaatccaactatagaagaaggaagaacgttacgtgttctaaagatggtagaaccatggctcagaggaaaccaattctgcataaaaatcctaaatccttacatgccaagtgtggtagaaactctggagcaaatgcaaagaaaacatggagggatgctagtgcgaaacccactctcaagaaattctacccatgaaatgtactgggtttcatgtggaacaggaaacattgtgtcggcagtgaacatgacatccagaatgttactaaatcgattcacaatggctcacaggaagccaacatatgaaagagacgtggacttaggcgctggaacaagacatgtggcagtggaacctgaggtagccaacctagatatcattggccagaggatagagaatataaaaaatgaacacaagtcaacatggcattatgatgaagacaatccatacaaaacatgggcctatcatggatcatatgaggtcaaaccatcaggatcagcctcatctatggtgaatggcgtggtgagattgctcacaaaaccatgggatgtcatccccatggtcacacaaatagccatgaccgataccacacccttcggacaacagagagtgtttaaagagaaagtggacacgcgcacaccaagagcaaaacgaggcacagcacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaattgggagagtttggaaaggcaaaaggaagtcgtgcaatatggtacatgtggctgggagcacgctttctagagttcgaagcccttggtttcatgaatgaagatcactggttcagtagagagaattcattcagtggagtggaaggagaaggactgcacaaacttggatacatactcagagacatatcaaagatcccggggggaaatatgtatgcagatgacacagccggatgggacacaagaataacagaggatgatcttcagaatgaggccaaaatcactgacatcatggagcctgaacacgctctattggctacgtcaatttttaagctgacctaccaaaacaaggtggtaagggtgcaaagaccagcaaaaaatggaaccgtgatggatgttatatccagacgagaccagagaggaagtgggcaggtcggaacctatggcttaaatactttcaccaatatggaggtccaactaataagacaaatggagtctgaaggaatctttttacccagcgaattggaaacccccaatctagctgagagagttcttgactggctggaaaaacatggcaccgaaaggctgaaaagaatggcaattagcggagatgattgtgtggtgaaaccggttgatgacaggtttgcaacagccttaatagctctgaatgacatgggaaaagtaagaaaagacataccgcagtgggaaccttcaaaaggatggaatgactggcagcaagtgcctttctgttcacaccatttccaccagctgatcatgaaggatgggagggaaatagtggtgccatgccgtaaccaagatgaacttgtgggcagggctagagtatcacaaggcgccggatggagcctgagagaaactgcttgcctaggcaagtcatatgcacaaatgtggcagctgatgtacttccacaggagagacctaagattagcggctaatgctatctgttcagctgtcccagttgactgggtcccaaccagccgcacaacctggtcaatccatgctcaccatcaatggatgacaacagaagatatgttatcagtgtggaatagggtttggatagaggaaaacccatggatggaggataaaactcacgtatccagctgggaagaagtcccatacttaggaaaaagggaagatcaatggtgtggatccctgataggcttgacagcgagggccacttgggccactaacatacaagtagccataaaccaagtgagaaggctcatcgggaacgagaattatctagattacatgacatcaatgaagagattcaagaatgagagtgatcccgaaggggcactctggtaa

SEQ ID NO: 5594 - RNA, 9879 nt, synthetic construct
  misc_feature 1..9879: note = derived and/or modified CDS sequence (wt) from DENV-1__EU482591__SS-prME
  source 1..9879: mol_type = other RNA
tccgtgaccatgctcctcatgctgctgcccacagccctggcgtttcatttgaccacacgagggggagagccacacatgatagttagtaagcaggaaagaggaaagtcactcttgtttaagacctctgcgggcgtcaatatgtgcaccctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggaaacaaatacaaagagtggaaacttgggctttgagacacccaggattcacggtgatagctttttttttagcacatgctataggaacatccatcactcagaaagggatcattttcatcttgctgatgctggtgacaccatcaatggccatgcgatgcgtgggaataggcaacagagacttcgttgaaggactgtcaggagcaacgtgggtggacgtggtactggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgcggactattcggaaagggaagtctattgacatgtgccaagttcaagtgtgtgacaaaactagaaggaaagatagttcaatatgaaaacctaaaatattcagtgatagtcactgtccacactggggaccagcaccaggtgggaaacgagaccacagaacatggaacaattgcaaccataacacctcaagctcccacgtcggaaatacagctgaccgactacggagccctcacattggactgctcacctagaacagggctggactttaatgagatggtgctattgacaatgaaagaaaaatcatggcttgtccacaaacaatggtttctagacttaccactgccatggacttcgggggcttcaacatcccaagagacctggaacagacaagatttgctggtcacattcaagacagctcatgcaaagaaacaggaagtagtcgtactgggatcacaggaaggagcaatgcacactgcgttgactggagcgacagaaatccagacgtcaggaacgacaacaattttcgcaggacatctgaaatgcagactaaaaatggataaactgaccttaaaggggatgtcatatgtgatgtgcacaggctcatttaagctagagaaggaagtggctgagacccagcatggaactgttctagtgcaggtcaaatatgaaggaacagacgcgccatgcaagatccccttttcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgtttagcggtgtttcttggaccatgaaaataggaatagggattctgctgacatggttgggattaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtgtgtggaattcgatcagccacgcgtcttgagaacatcatgtggaagcagatatcaaatgaattgaaccacattctacttgagaatgacatgaaattcacagtggttgtaggagatgccaacggaattttggcccaaggaaaaaaaatgattaggccacaacccatggaacacaaatactcatggaaaagctggggaaaagctaaaatcataggagcagacatacaaaataccaccttcatcatcgacggcccagacaccccagaatgtcccgatggccaaagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacagcagggccatggcacctaggtaagttggaactggattttgacttgtgtgaaggtaccacagttgttgtggatgaacattgtggaaatcgaggtccatctctcagaactacaacagtcacaggaaagataatccatgaatggtgttgcagatcctgcacgctaccccccttacgtttcagaggagaagacggatgttggtatggcatggaaatcagaccagtgaaggagaaggaggagaatctagttaggtcaatggtctctgcagggtcaggagaagtggatagtttttcattaggaatactatgcgtatcaataatgattgaagaagtgatgagatccagatggagtagaaagatgctgatgactggaacactggctgtttttctccttcttataatgggacaactgacatggaatgatctgattaggttatgcatcatggttggagctaatgcttcagacaggatggggatgggaacaacgtacctagccttgatggctactttcaaaatgagaccaatgttcgctgtagggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttattgtctctgacatttgtcaaaacaactctctcattggattatgcatggaaaacaacggctatggcactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagctcactcctcaaaaatgatgtgccgttggccgggccactaatagctggaggcatgctaatagcatgttatgtcatatccggaagctcagccgatttatcattggagaaagcggctgaagtatcctgggaacaagaagcagaacactccggtgcctcacacagcatattagtagaggtccaagatgatggaactatgaaaataaaagatgaagagagggatgacacactcaccatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgataatggcatctatagaatcttgcaaagaggactgttgggcaggtcccaagtaggagtgggagtcttccaagacggcgtgttccacacaatgtggcacgtcaccagaggagctgtccttatgtaccaagggaagagactggaaccaagctgggccagtgtcaaaaaggacttgatctcatatggaggaggttggaggttccaaggatcatggaacacgggagaagaagtgcaggtgatagctgttgaaccaggaaaaaaccccaaaaatgtacagacaacgccgggcaccttcaagactcctgaaggcgaagttggagccatagctctagatttcaaacccggcacatctggatctcccattgtgaacagagagggaaaaatagtgggtctgtatggaaatggagtggtgacaacaagtggaacctacgtcagtgccattgcccaagctaaagcatcacaggaagggcctctaccagagattgaggacgaggtatttaagaaaagaaacttaacaataatggacctgcacccaggatcagggaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttatatgggacagcctttaaataatgatgaggatcacgctcattggacagaagcaaaaatgctccttgacaatataaacacaccagaagggatcatcccagccctttttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggacgccagaacatactctgatccattggccctgcgcgagtttaaagagttcgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggcctagggaaaacatccattggcttgctctgtgtgacggcctcaagcgcactgttatggatggccagtgtggagccccattggatagcggcctccatcatactagagttcttcttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgccacaatgctggacgtagacctacacccagcttcagcctggaccctctatgcagtagccacaacagtcatcactcccatgatgagacacacaattgaaaatacaacggcaaacatttccctgaccgccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttattgatactttgtacatcacagatcctcttgatgcggaccacatgggccttgtgtgaatccatcacactggctactggacccctgaccactctctgggagggatctccaggaaaattctggaataccacaatagcagtgtccatggcaaatatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcaagaggaacagccaaactgaggtggtttgtggagaggaacctcgtgaaaccagaaggaaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaagctacactctggaaaggatgtattttttatgccacctgagaaatgtgacacccttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcgaatgcaaagaaaacatggagggatgctagtgcgaaacccactctcaagaaattccacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacgaaaccatgggatgttatccccatggtcacacaaatagctatgactgataccacaccctttggacaacagagagtgtttaaagagaaagttgacacgcgcacaccaagagcaaaacgaggcacaacacagattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggccaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgatcagagaggaagtggacaggtcggaacttatggcttaaatactttcaccaatatggaggtccaactaataagacaaatggagtctgaaggaatctttttacccagcgaattggaaacccccaacctagctgagagggctcttgactggttagaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcaaaaggatggaatgattggcagcaagtgcctttttgttcacaccatttccaccaactgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctaggaaaaagggaagatcaatggtgtggatccctgataggcttgacagcgagggccacctgggccaccaacatacaagtagctataaaccaagtgagaaggctcatcgggaatgagaattatttagattacatgacatcaatgaagagattcaagaatgagagtgattccgaaggagcactctggtaa

SEQ ID NO: 5595 - RNA, 9879 nt, synthetic construct
  misc_feature 1..9879: note = derived and/or modified CDS sequence (wt) from DENV-1__EU482592__SS-prME
  source 1..9879: mol_type = other RNA
tctgtgaccatgctcctcatgctgctgcccacagccctggcgttccatttgactacacgagggggagagccacacatgatagttagtaagcaggaaagaggaaagtcactgttgtttaagacctctgcaggcatcaatatgtgcactctcattgcgatggatctgggagagttatgcgaggacacaatgacctacaaatgcccccggatcactgaggcggaaccagatgacgttgactgctggtgcaatgccacagacacatgggtgacctatgggacatgttctcaaaccggcgaacaccgacgagacaaacgttccgtggcactggccccacacgtgggacttggtctagaaacaagaaccgaaacatggatgtcctctgaaggtgcctggaaacaaatacaaaaagtggagacttgggctttgagacacccaggattcacggtgacagccctttttttagcacatgccataggaacatccattactcagaaagggatcattttcattttgctgatgctagtaacaccatcaatggccatgcgatgtgtgggaataggcaacagggacttcgttgaaggactgtcaggagcaacgtgggtggacgtagtattggagcatggaagctgcgtcaccaccatggcaaaagataaaccaacattggacattgaactcttgaagacggaggtcacaaaccctgccgtcttgcgcaaactgtgcattgaagctaaaatatcaaacaccaccaccgattcaaggtgtccaacacaaggagaggccacactggtggaagaacaagactcgaactttgtgtgtcgacgaacgtttgtggacagaggctggggtaatggctgcggactatttggaaaaggaagcctactgacgtgtgctaagttcaagtgtgtgacaaaactagaagggaagatagttcaatatgaaaacttaaaatattcagtgatagtcactgtccacactggggaccagcaccaggtgggaaacgagactacagaacatggaacaattgcaactataacacctcaagctcctacgtcggaaatacagctgactgactacggagccctcacattggactgctcacctagaacagggctggactttaatgagatggttctattgacaatgaaagaaaaatcatggcttgtccacaaacaatggtttctagacttaccactgccttggacttcaggagcttcaacatctcaagagacttggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacgatctttgcaggacacctgaaatgcagactaaaaatggataaactgactttaaaagggatgtcatatgtaatgtgcacaggctcatttaagctagagaaggaagtggctgagacccagcatggaactgttctagtgcaggttaaatacgaaggaacagatgcaccatgcaagatccctttttcggcccaagatgagaaaggagtgacccagaatgggagattgataacagccaaccccatagtcactgacaaagaaaaaccagtcaacattgagacagaaccaccttttggtgagagctacatcgtggtaggggcaggtgaaaaagctttgaaactgagctggttcaagaaagggagcagcatagggaaaatgttcgaagcaactgcccgaggagcacgaaggatggctatcctgggagacaccgcatgggactttggctctataggaggagtgttcacatcagtgggaaaattggtacaccaggtttttggagccgcatatggggttctgttcagcggtgtttcttggaccatgaaaataggaatagggattctgctgacatggttgggattaaattcaaggagcacgtcactttcgatgacgtgcattgcggttggcatggtcacactgtacctaggagtcatggttcaagcggactcgggatgtgtaatcaactggaagggcagagaactcaaatgtggaagtggtatttttgtcactaatgaagtccacacttggacagagcaatacaaattccaggctgactccccaaaaagactgtcagcagccattgggaaggcatgggaagagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacatagatactcatggaaaagctggggaaaagccaaaatcataggagcagacatacagaatagcaccttcatcatcgacggcccagatactccagaatgccccgatgaccaaagagcgtggaacatttgggaagttgaagactatgggtttggaattttcacgacaaacatatggctgaaattgcgcgactcctacacccaaatgtgtgaccaccggctaatgtccgctgccatcaaagacagcaaggcagtccatgctgacatggggtactggatagaaagtgaaaagaacgagacctggaagctagcgagagcctccttcatagaagtcaagacatgtatctggccaaaatcccacactctatggagtaatggagttttggaaagtgaaatgataatcccaaagatatatggaggaccaatatctcagcacaactacagaccagggtatttcacacaaacagcagggccatggcacctaggcaagttggaattggatttcgacttgtgtgaaggtaccacagttgttgtggatgaacattgtggaaatcgaggcccatctctcagaactacaacagtcacaggaaagataatccatgaatggtgttgcagatcctgcacgttaccccccttacgcttcagaggagaagacggatgttggtatggcatggaaatcagaccagttaaggagaaggaggaaaacctagttaggtcaatggtctctgcagggtcaggagaagtggacagtttttcactagggatactatgcgtatcaataatgattgaagaagtgatgagatccagatggagtagaaagatgctgatgactggaacattggctgttttcctccttcttataatgggacaactgacatggaatgacctgattaggttatgcatcatggttggagctaatgcttcagacaggatggggatgggaacaacgtacctggccttgatggctactttcaaaatgagaccaatgttcgctgttgggctactatttcgcagactaacatccagagaagttcttcttctcacgattggattaagcctggtggcatccgtggagttaccaaattctttggaggagctaggggatggacttgcaatgggtatcatgatgttaaaattattgactgaatttcagccacaccagttatggaccaccttactgtctttgacatttatcaaaacaactctttcattggattatgcatggaggacaatggctatggtgctgtcaatcgtatctctctttcctttatgtctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactccttaaaaatgatgtgccgttggccggcccactaatagctggaggcatgctaatagcatgttatgtcatatccggaagctcagccgatttatcattggagaaagcggctgaggtatcctgggaagaagaagcagaacactctggtacctcacacaacatattagtagaggtccaagatgatggaactatgaaaataaaagatgaagagagggatgacacactcaccatactcctcaaagcaactctgctggcagtctcaggagtgtacccaatgtcaataccagcaactcttttcgtgtggtatttttggcagaaaaagaaacagagatcaggagtgttatgggacacacccagccctccggaagtggaaagagcagttcttgatgatggcatctatagaatcctgcaaagaggactgttgggcaggtcccaagtgggagtgggagttttccaggacggcgtgttccacacaatgtggcacgtcaccaggggagctgtccttatgtaccaagggaagaggttggaaccaagctgggccagtgtcaaaaaggacttgatctcatatggaggaggttggagatttcaaggatcatggaacacgggagaagaggtgcaggtgatagccgttgaaccaggaaaaaatcctaaaaatgtacagacaacgccgggtaccttcaagactcccgaaggcgaagttggagccatagctctagattttaaacccggcacatctggatctcccatcgtgaacagagagggaaaaatagtaggtctttatggaaatggagtggtgacaacaagtggaacctacgtcagtgccattgcccaagctaaaacatcacaagaagggcctctaccagagattgaggaggaggtgtttaagaaaaggaacttaacaataatggacctgcatccaggatcgggaaaaacaagaagatatcttccagccatagtccgtgaggccataaaaaggaaactgcgcacgttaatcttggctcccacaagagttgtcgcctctgaaatggcagaggcgctcaagggaatgccaataagatatcagacaacagcagtgaagagtgaacacacaggaagggagatagtagacctcatgtgccacgccacttttaccatgcgtctcttatctccagtgagagttcccaattacaacatgattatcatggatgaagcacattttaccgatccagccagcatagcggccagagggtacatctcaactcgagtgggtatgggtgaagcagctgcgatctttatgacagccactcccccaggatcggtggaggcctttccacaaagtaatgcagttatccaagatgaggaaagagacattcctgagagatcatggaactcaggctacgactggatcactgattttccaggtaaaacagtctggtttgttccaagcattaagtcaggaaatgacattgctaactgtttaagaaagaacggaaaacgggtgatccaattgagcagaaaaacctttgacactgagtaccagaaaacaagaaacaatgactgggactatgttgtcacaacagacatttccgaaatgggggcaaatttccgggccgacagggtaatagacccaaggcggtgcttgaaaccagtgatactaaaagatggtccagagcgtgtcattctagccggaccgatgccagtgactgtggccagtgctgcccagagaagaggaagaattggaaggaaccaaaacaaggaaggtgatcagtacgtttatatgggacagcctttaaataatgatgaggatcacgctcattggacagaagcaaaaatgctccttgacaatataaacactccagaagggatcattccagccctctttgagccagagagagaaaagagtgcagcaatagatggagagtacagactgcggggagaagcaaggaaaacgttcgtggagctcatgagaagaggagatctaccagtttggctatcctacaaagttgcctcagaaggtttccagtactccgacagaaggtggtgctttgacggggaaaggaacaaccaggtgttggaggagaacatggacgtggagatctggacaaaggaaggagaaaggaagaaattgcgaccccgctggttggatgccagaacatactctgatccactggcccttcgtgagttcaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgctatggaggaactaccagacaccatagaaacattgatgctcctagctttgatagctgtgctgactggtggagtgacgctgttcttcctatcaggaaaaggtctagggaaaacatccattggcctgctctgtgtgatggcctcaagcgcactgttatggatggccaatgtggagccacattggatagcggcctccatcatactagagttctttctgatggtgctgctcattccagagccagacagacagcgcactccacaggacaaccagctagcatacgtggtgataggtttgttattcatgatactgacagtggcagccaatgagatgggattattggaaaccacaaagaaagacctggggattggctatgtagccgccgaaaaccaacaccatgccacgatgctggacgtagacctacgcccagcttcagcctggaccctctatgcagtagccacaacagttatcactcccatgatgagacacacaattgaaaacacaacagcaaacatttccctgacagccattgcaaaccaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagttaggccaaataatgttactgatactttgtacatcacagattctcttgatgcggaccacatgggccctgtgtgaatccatcacactggctactggacccttgaccactctctgggagggatctccaggaaaattctggaataccacgatagcagtgtccatggcaaacatcttcaggggaagttatctagcaggagcaggtctggccttctcgttaatgaaatctttgggaggaggcaggagaggtacgggggctcaaggagaaacactgggagagaaatggaaaagacagttaaaccaactgagcaagtcagaattcaacacctacaaaaggagtgggattatggaggtggacagatccgaagccaaagagggattaaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtcaagggatacacaaaaggaggacctggacatgaggaacctatcccaatggcgacctatggatggaacctagtaaagctatactctggaaaagatgtattttttacaccacctgagaaatgtgatacccttctgtgtgatataggagagtcctctccgaatccaactatagaagaaggaagaacgttacgtgttctaaagatggtagaaccatggctcagaggaaaccaattctgcataaaaattctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatgactcacaggaaaccaacatatgaaagagacgtggacttaggcgctggaacaagacatgtggcagtggaaccagaggtagccaacctagatattattggccagaggatagagaatataaaaaatgaacacaagtcaacatggtattatgatgaagacaatccatacaaaacatgggcctatcatggatcatatgaggtcaaaccatcaggatcagcctcatctatggtgaatggcgtggtgagattgctcacaaaaccatgggatgtcatccccatggtcacacaaatagccatgaccgataccacacccttcggacaacagagagtgtttaaagagaaagtagatacgcgcacgccgagagcaaaacgaggcacagcacaaattatggaggtgacagccaagtggctatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggaacttcataaacagggaaaatgtgccacgtgtgtctacaacatgatggggaagagagagaaaaaattgggagagtttggaaaggcaaaaggaagtcgtgcaatatggtacatgtggctgggagcacgctttctagagttcgaagcccttggtttcatgaatgaagatcactggttcagtagagagaattcattcagtggagtggaaggagaaggactgcacaaacttggatacatactcagagacatatcaaagatcccggggggaaacatgtatgcagatgacacagccggatgggacacaagaataacagaggatgatcttcagaatgaggccaaaatcactgacatcatggagcctgaacacgctctattagctacgtcaatttttaagctgacctaccaaaacaaggtggtaagggtgcaaagaccagcaaaaaatggaaccgtgatggatgttatatccagacgagaccagagaggaagtgggcaggtcggaacctatggcttaaatactttcaccaatatggaggtccaactaataagacaaatggagtctgaaggaatctttttacccagcgaattggaaacccccaatctagctgagagagttcttaactggttggaaaaacatggcactgaaaggctgaaaagaatggcaattagcggagatgattgtgtggtgaaaccagttgatgacaggtttgcaacagccttaatagctctgaatgacatgggaaaagtaagaaaagacataccgcagtgggaaccttcaaaaggatggaatgactggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctaagactagcggctaatgctatctgttcagctgtcccagttgactgggttccaaccagccgcacaacctggtcaatccatgctcaccatcaatggatgacaacagaagatatgttatcagtgtggaatagggtttggatagaggaaaacccatggatggaggataaaactcatgtgtccagctgggaagaagtcccatacttagggaaaagggaagatcaatggtgtggatccctgataggcttgacagcgagggccacttgggccactaacatacaagtggccataaaccaagtgagaaggctcatcggaaatgagaattatctagattacatgacatcaatgaagagattcaagaatgagagtgatcccgaaggggcactctggtaa

SEQ ID NO: 5596 - RNA, 9879 nt, synthetic construct
  misc_feature 1..9879: note = derived and/or modified CDS sequence (wt) from DENV-1__EU482609__SS-prME
  source 1..9879: mol_type = other RNA
tccgtgaccatgctcctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccggatcactgaggcggaaccagatgacgttgactgttggtgcaatgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacctgggctttgagacacccaggattcacggtgatagccctttttttagcacatgctataggaacatccatcactcagaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactagtggaagaacaagacgcgaactttgtgtgtcgccgaacgtttgtggacagaggctggggtaacggctgcggactattcggaaagggaagtctattgacgtgtgccaagttcaagtgtgtgacaaaactagaaggaaagatagttcaatatgagaacttaaaatattcagtgatagtcaccgtccacactggggaccagcatcaggtgggaaacgagaccacagaacatggaacaattgcaaccataacacctcaagctcctacgtcggaaatacagctgaccgactacggagcccttacattggactgctcacctagaacagggctggactttaatgagatggtgctattgacaatgaaagaaaaatcatggcttgtccacaaacaatggtttctagacttaccactgccatggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagactaaaaatggataaactgactttaaaggggatgtcatatgtgatgtgcacaggctcattcaagctagagaaggaagtggctgagacccaacatggaactgttctagtgcaggtcaaatacgaaggaacagacgcgccatgcaagatccccttctcgactcaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagaaaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgttcagcggtgtttcttggaccatgaaaataggaatagggattctgttgacatggttgggattaaattcaaggagcacgtcactttcgatgacgtgcattgcagttggcatggtcacactgtacctaggagtcatggttcaagcggactcgggatgtgtgatcaactggaagggcagagaacttaaatgtggaagtggcatttttgtcactaatgaagtccacacttggacagagcaatacaaattccaggctgactccccaaaaagactgtcagcagccattggaaaggcatgggaggagggagtgtgtggaattcgatcagccacgcgtcttgagaacatcatgtggaagcaaatatcaaatgaattgaaccacattctacttgaaaatgatatgaaattcacagtggttgtaggagatgctaacggaattttggcccaagggaaaaaaatgattaggccacaacccatggaacacaaatactcatggaaaagctggggaaaagctaaaatcataggagcagacatacaaaataccacctttatcatcgacggcccagacaccccagaatgtcccgatggccaaagagcatggaacatttgggaagttgaggactatgggtttggaattttcacgacaaacatatggctgaaattgcgtgactcctacacccaaatgtgtgaccaccggctaatgtcagctgccatcaaggacagcaaggcagttcatgctgacatggggtactggatagaaagcgaaaagaacgaaacctggaagctggcgagagcctccttcatagaagtcaagacatgcacctggccaaaatctcacactctatggagcaatggagttttggaaagtgaaatgataatcccaaagatatatggaggaccaatatctcagcacaactacaggccagggtatttcacacaaacagcagggccatggcacctaggtaagttggaactggattttgacttgtgtgaaggcaccacagttgttgtggatgaacattgtggaaatcgaggtccatctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcaggttaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttactgtctttgacatttgtcaaaacaactctctcattggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactcctaaaaaatgatgtgccattggccggcccactaatagctggaggcatgctaatagcatgttatgtcatatccggaagctcagccgatttatcactggagaaagcggctgaggtgtcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagcgatcaggagtgttatgggacacacccagccctccggaagtggaaagagcagttcttgatgatggcatctatagaatcttgcaaagaggactgttgggcaggtcccaagtaggagtgggagtcttccaagacggcgtgttccacacaatgtggcatgtcaccaggggagctgtccttatgtaccaagggaagaggctggaaccaagctgggccagtgtcaaaaaggacttgatctcatatggaggaggttggagatttcaaggatcatggaacacgggagaagaagtgcaggtgatagctgttgaaccaggaaaaaaccccaaaaatgtacagacaacgccgggtaccttcaagactcctgaaggcgaagttggagccatagctctagatttcaaacccggcacatctggatctcccattgtgaacagagagggaaaaatagtgggtctttatggaaatggagtggtaacaacaagtggaacctacgtcagtgccattgcccaagctagagcatcacaggaagggcctctaccagagattgaggacgaggtgtttaagaaaagaaacttaacaataatggacctgcacccaggatcaggaaaaacaagaagatatcttccagccatagtccgtgaggccataaaaaggaaactgcgtacgttaatcttggctcccacaagagttgtcgcctctgaaatggcagaggcactcaagggaatgccaataagataccagacaacagcagtgaagagtgaacacacaggaagggagatagttgacctcatgtgccacgctacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggccttcccacagagcaatgcagttatccaagatgaggaaagagacattcctgagagatcatggaactcaggctacgactggatcactgattttccaggtaaaacagtctggtttgttccaagcattaaatcaggaaatgacattgccaactgtttaagaaagaacggaaaacgggtaatccaactgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgaccgtggccagtgctgcccagagaagaggaagaattggaaggaaccaaaacaaggaaggtgatcagtatgtttacatgggacagcctttaaataatgatgaggatcacgctcattggacagaagcaaaaatgctccttgacaatataaacacaccagaagggattatcccagccctctttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggatgccagaacatactctgatccactggctctgcgcgagtttaaagagtttgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacacgctatggaggaactaccagacaccatagaaacactgatgcttctagctttgatagctgtgttgactggtggagtgacgctattcttcctatcaggaaaaggtttagggaaaacatctattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacacgctacaatgctggacgtagacctacgcccagcttcagcctggaccctctatgcagtagccacaacagtcatcactcccatgatgagacacacaattgaaaatacaacggcaaacatttccctgacagccattgcaaatcaggcagctatattgatgggacttgacaagggatggccaatatcaaagatggacataggagttccacttctcgccttagggtgctattcccaggtgaacccattgacactgacagcggcggtgttgatgttagtggctcattatgccataattggaccaggactgcaagcaaaagccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttttcattaatgaaatctttaggaggaggtaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaaggaaaagtcatagacctcggttgtggaagaggtggctggtcatactattgtgctgggctgaagaaagttactgaagtgaagggatacacaaaaggaggacctggacatgaggaacccatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttctaaaaatggtggaaccatggctcaaaggaaaccaattctgcataaaaatcctaaacccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatattatcggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacaaattatggaggtgacagccaggtggttatggggtttcctttccagaaacaaaaaacccagaatctgcacaagagaggagttcacaagaaaggttaggtcaaacgcggcaataggagcagtgttcgttgatgaaaaccaatggaactcggcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccagggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgaccagagaggaagtggacaggtcggaacttatggcttaaatactttcaccaatatggaggtccaactaataagacaaatggagtctgaaggaatcttttcacccagcgaattggaaactcccaacctagctgagagagttcttgactggttggaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggagccttcaaaaggatggaatgattggcagcaagtgcctttctgttcacaccatttccaccagctgatcatgaaggatgggagggaaatagtggtgccatgccgcaaccaagatgaacttgtgggcagggccagagtatcgcaaggcgccggatggagcctgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcctgaaggagcactctggtaa

SEQ ID NO: 5597 - RNA, 9879 nt, synthetic construct
  misc_feature 1..9879: note = derived and/or modified CDS sequence (wt) from DENV-1__EU482610__SS-prME
  source 1..9879: mol_type = other RNA
tccgtgaccatgctcctcatgctgctgcccacagccctggcgtttcatttgaccacacgagggggagagccacacatgatagttagtaagcaggaaagaggaaagtcactcttgtttaagacctctgcgggcgtcaatatgtgcaccctcattgcgatggacttgggagagttatgtgaggacacaatgacctacaaatgcccccggatcactgaggcggaaccagatgacgttgactgctggtgtaatgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggaaacaaatacaaagagtggaaacttgggttttgagacacccaggattcacggtgatagccttttttttagcacatgctataggaacatccatcactcaaaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgcggactattcggaaagggaagtctattgacgtgtgccaagttcaagtgtgtgacaaaactagaaggaaagatagttcaatatgaaaacttaaaatattcagtgatagtcactgtccacactggggaccagcaccaggtgggaaacgagaccacagaacatggaacaattgcaaccataacacctcaagctcccacgtcggaaatacagctgaccgactacggagccctcacattggactgctcacctagaacagggctggactttaatgagatggtgctattgacaatgaaagaaaaatcatggcttgtccacaaacaatggtttctagacttaccactgccatggacttcgggggcttcaacatctcaagagacctggaacagacaagatttgctggtcacattcaagacagctcatgcaaagaaacaggaagtagtcgtactgggatcacaggaaggagcaatgcacacagcgttgactggggcgacagaaatccagacgtcaggaacgacaacaatcttcgcaggacacctgaaatgcagactaaaaatggataaactgaccttaaaggggatgtcatatgtgatgtgcacaggctcatttaagctagagaaggaagtggctgagacccagcatggaactgttctagtgcaggtcaaatatgaaggaacagacgcgccatgcaagatccccttttcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgtttagcggtgtttcttggaccatgaaaataggaatagggattctgctgacatggttgggattaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtgtgtggaattcgatcagccacgcgtcttgagaacatcatgtggaagcaaatatcaaatgaattgaaccacattctacttgagaatgacatgaaactcacagtggttgtaggagatgccaacggaattttggcccaagggaaaaaaatgattaggccacaacctatggaacacaaatactcatggaaaagctggggaaaagctaaaatcataggagcagacatacaaaatactaccttcatcatcgacggcccagacaccccagaatgtcccgatggccaaagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacagcagggccatggcacctaggtaagttggaactggattttgacttgtgtgaaggtaccacagttgttgtggatgaacattgtggaaatcgaggtccatctctcagaaccacaacagtcacaggaaagataatccatgaatggtgttgcagatcctgcacgctaccccccttacgtttcagaggagaagacgggtgttggtatggcatggaaatcagaccagtaaaggagaaggaggagaatctagtcaggtcaatggtctctgcagggtcaggagaagtggatagtttttcattaggaatactatgcgtgtcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttattgtctctgacatttgtcaaaacaactctctcactggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagctcactcctcaaaaatgatgtgccgttggccgggccactaatagctggaggcatgctaatagcatgttatgtcatatccggaagctcagccgatttatcattggagaaagcggctgaagtatcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttggggaggtcccaagtaggagtaggagtcttccaagacggcgtgttccacacaatgtggcacgttaccaggggagctgtccttatgtaccaagggaagagactggaaccaagctgggccagtgtcaaaaaggacttgatctcatatggaggaggttggaggttccaaggatcatggaacacaggagaagaagtgcaggtgatagctgttgaaccaggaaaaaaccccaaaaatgtacagacaacgccgggcaccttcaagactcctgaaggcgaagttggagccatagctctagacttcaaacccggcacatctggatctcccattgtgaacagagagggaaaaatagtgggtctgtatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcagggaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattataacatgattattatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctttttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggacgccagaacatactctgatccattggccctgcgcgagtttaaagagttcgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgctacaatgctggacgtagacctacacccagcttcagcctggaccctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctataaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaagctacactctggaaaggatgtattttttatgccacctgagaaatgtgacacccttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatctagaatgttactgaaccgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacagattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaattaggagagtttggaaaagcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatacttagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgtcatatccagacgtgatcagagaggaagtggacaggtcggaacttatggcttaaatactttcaccaatatggaggtccaactaataagacaaatggagtctgaaggaatctttttacccagcgaattggaaacccccaacctagctgagagggctcttgactggctagaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcaaaaggatggaatgattggcagcaagtgcctttttgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctaggaaaaagggaagaccaatggtgtggatccctgataggcttgacagcgagggccacctgggccaccaacatacaagtagccataaaccaagtgagaaggctcatcgggaatgagaattatttagattacatgacatcaatgaagagattcaagaatgagagtgatcccgaaggagcactctggtaa

SEQ ID NO: 5598 - RNA, 9879 nt, synthetic construct
  misc_feature 1..9879: note = derived and/or modified CDS sequence (wt) from DENV-1__EU482611__SS-prME
  source 1..9879: mol_type = other RNA
tccgtgaccatgctcctcatgctgctgcccacagccctggcgtttcatttgaccacacgagggggagagccacacatgatagttagtaagcaggaaagaggaaagtcactcttgtttaagacctctgcgggcgtcaatatgtgcaccctcattgcgatggacttgggagagttatgtgaggacacaatgacctacaaatgcccccggatcactgaggcggaaccagatgacgttgactgctggtgtaatgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggaaacaaatacaaagagtggaaacttgggctttgagacacccaggattcacggtgatagccttttttttagcacatgctataggaacatccatcactcaaaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgcggactattcggaaagggaagtctattgacgtgtgccaagttcaagtgtgtgacaaaactagaaggaaagatagttcaatatgaaaacttaaaatattcagtgatagtcactgtccacactggggaccagcaccaggtgggaaacgagaccacagaacatggaacaattgcaaccataacacctcaagctcccacgtcggaaatacagctgaccgactacggagccctcacattggactgctcacctagaacagggctggactttaatgagatggtgctattgacaatgaaagaaaaatcatggcttgtccacaaacaatggtttctagacttaccactgccatggacttcgggggcttcaacatctcaagagacctggaacagacaagatttgctggtcacattcaagacagctcatgcaaagaaacaggaagtagtcgtactgggatcacaggaaggagcaatgcacacagcgttgactggggcgacagaaatccagacgtcaggaacgacaacaatcttcgcaggacacctgaaatgcagactaaaaatggataaactgaccttaaaggggatgtcatatgtgatgtgcacaggctcatttaagctagagaaggaagtggctgagacccagcatggaactgttctagtgcaggtcaaatatgaaggaacagacgcgccatgcaagatccccttttcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatacggggttctgtttagcggtgtttcttggaccatgaaaataggaatagggattctgctgacatggttgggattaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtgtgtggaattcgatcagccacgcgtcttgagaacatcatgtggaagcaaatatcaaatgaattgaaccacattctacttgagaatgacatgaaactcacagtggttgtaggagatgccaacggaattttggcccaagggaaaaaaatgattaggccacaacctatggaacacaaatactcatggaaaagctggggaaaagctaaaatcataggagcagacatacaaaatactaccttcatcatcgacggcccagacaccccagaatgtcccgatggccaaagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacagcagggccatggcacctaggtaagttggaactggattttgacttgtgtgaaggtaccacagttgttgtggatgaacattgtggaaatcgaggtccatctctcagaaccacaacagtcacaggaaagataatccatgaatggtgttgcagatcctgcacgctaccccccttacgtttcagaggagaagacgggtgttggtatggcatggaaatcagaccagtaaaggagaaggaggagaatctagtcaggtcaatggtctctgcagggtcaggagaagtggatagtttttcattaggaatactatgcgtgtcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttattgtctctgacatttgtcaaaacaactctctcactggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagctcactcctcaaaaatgatgtgccgttggccgggccactaatagctggaggcatgctaatagcatgttatgtcatatccggaagctcagccgatttatcattggagaaagcggctgaagtatcctgggaacaagaagcagaacactccggtgcctcacacaacatattagtagaggtccaagatgatggaaccatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttggggaggtcccaagtaggagtaggagtcttccaagacggcgtgttccacacaatgtggcacgttaccaggggagctgtccttatgtaccaagggaagagactggaaccaagctgggccagtgtcaaaaaggacttgatctcatatggaggaggttggaggttccaaggatcatggaacacaggagaagaagtgcaggtgatagctgttgaaccaggaaaaaaccccaaaaatgtacagacaacgccgggcaccttcaagactcctgaaggcgaagttggagccatagctctagatttcaaacccggcacatctggatctcccattgtgaacagagagggaaaaatagtgggtctgtatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcagggaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattataacatgattattatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaaggaatcatcccagccctttttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggacgccagaacatactctgatccattggccctgcgcgagtttaaagagttcgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgctacaatgctggacgtagacctacacccagcttcagcctggaccctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaagctacactctggaaaggatgtattttttatgccacctgagaaatgtgacacccttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatctagaatgttactgaaccgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagccatgactgataccacaccctttggacaacagagagtgtttaaagagaaagttgacacgcgcacaccaagagcaaaacgaggcacaacacagattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaattaggagagtttggaaaagcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatacttagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgtcatatccagacgtgatcagagaggaagtggacaggtcggaacttatggcttaaatactttcaccaatatggaggtccaactaataagacaaatggagtctgaaggaatctttttacccagcgaattggaaacccccaacctagctgagagggctcttgactggctagaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcaaaaggatggaatgattggcagcaagtgcctttttgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaagacaaaactcatgtatccagttgggaagaagttccatacctaggaaaaagggaagaccaatggtgtggatccctgataggcttgacagcgagggccacctgggccaccaacatacaagtagccataaaccaagtgagaaggctcatcgggaatgagaattatttagattacatgacatcaatgaagagattcaagaatgagagtgatcccgaaggagcactctggtaa

SEQ ID NO: 5599 - RNA, 9879 nt, synthetic construct
  misc_feature 1..9879: note = derived and/or modified CDS sequence (wt) from DENV-1__FJ639735__SS-prME
  source 1..9879: mol_type = other RNA
tccgtgaccatgctcctcatgctgctgcccacagccctggcgttccatttgaccacacgagggggagagccacacatgatagttagtaagcaggaaagaggaaagtcactcttgtttaagacctcggcaggtgtcaatatgtgcactctcattgcgatggacttgggagagttatgtgaggacacaatgacctacaaatgcccccggatcactgaggcggaaccagatgacgttgactgctggtgcaatgccacagacacatgggtgacctatggaacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgacagccctttttttagcacatgccataggaacatccatcactcagaaagggatcattttcattttgctaatgctggtgacaccatcaatggccatgcgatgcgtgggaataggtaacagagacttcgttgaaggactgtcaggagcaacgtgggtggacgtggtattggagcatggaagctgcgtcaccaccatggcaaaaaataaaccaaccttggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgcggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcaaccataacacctcaagctcccacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacacctgaaatgcagactaaaaatggataaactgactttaaaggggacgtcatatgtgatgtgcacaggctcatttaagctagagaaggaagtggctgagacccaacatggaactgttctagtgcaggtcaaatacgaaggaacagacgcgccatgcaagatccccttttcgacccaagatgagaaaggagtgacccagaatgggagattgataacagccaatcccatagttactgacaaagaaaaaccagtcaacattgagacagaaccaccttttggtgagagctacatcgtggtaggggcaggtgaaaaagctttgaaactaagctggttcaagaaaggaagcagcatagggaaaatgttcgaagcaactgcccgaggagcacgaaggatggctatcctgggagacaccgcatgggacttcggctctataggaggagtgttcacatctgtaggaaaattggtacaccaggtttttggaaccgcatatggggttctgttcagcggtgtttcttggaccatgaaaataggaatagggattctgctgacatggttgggattaaattcaaggagcacgtcactttcgatgacgtgcattgcagttggcatggttacactgtacctaggagtcatggttcaagcggactcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaatcataggagcagacatacaaaataccaccttcatcatagacggcccagataccccagaatgccccgatgaccaaagagcgtggaacatttgggaagttgaggactatgggtttggaattttcacgactaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacagcagggccatggcacctaggcaagttggaattggattttaacttgtgtgaaggtaccacagttgttgtggatgaacattgtggaaatcgaggtccatctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcgatggtctctgcagggtcaggagaagtggatagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattgtttcgcagactaacatccagagaagttcttcttctcacgattggattaagcctggtggcatccgtagagctaccaaattctttggaggagctaggggatggacttgcaatgggtatcatgatgttaaaattattgactgaatttcagccacaccagttatggaccaccttactgtctctgacatttatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactgagttcactcctcaaaaatgatgtgccgttggccggcccactaatagctggaggcatgctaatagcatgttatgtcatatccggaagctcagccgatttatcattggagaaagcggctgaggtgtcctgggaacaagaagcagaacactcaggtacctcacacaacatattagtagaggtccaagatgatggaactatgaaaataaaagatgaagagaaggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttgggcagatcccaagtgggagtgggagttttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggcgaagttggagccatagctctagattttaaacccggcacatctggatctcccatcgtgaacagagagggaaaaatagtaggtctttatggaaatggagtggtgacaacaagtggaacctacgtcagtgccattgctcaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagtagacctcatgtgccacgccacttttaccatgcgtctcttatccccagtgagagttcccaattacaacatgattgttatggatgaagcacattttaccgatccagccagcatagcggccagagggtacatctcaacccgagtgggtatgggtgaagcagctgcgatctttatgacagccactcccccaggatcggtagaggcctttccacagagcaatgcagttatccaagatgaggaaagagacattcctgagagatcatggaactcaggctacgactggatcactgattttccaggtaaaacagtctggtttgtcccaagcattaaatcaggaaatgacattgccaactgtttaagaaagaacggaaaacgggtaatccaattgagcagaaaaacctttgacactgagtaccagaaaacaaaaaacaatgattgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataacgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccactggctctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgctatggaggaactaccagacaccatagaaacattgatgcttctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttcttcttgatggtgctgctcattccagagccagacagacagcgcactccacaggacaaccagctagcatatgtggtgataggtttgttattcatgatactgacagtggcagccaatgagatgggattattggaaaccacaaagagagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaactgtagacgggattgttgcaatagacttggatcctgtggtttatgatgcaaaatttgaaaaacagctaggccaaataatgctactgatactttgtacatcacagatcctcttgatgcggaccacatgggccttgtgtgaatccatcacactggcgactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactaaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttttgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaatattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtaaatggagtggtgagattgctcacaaaaccatgggatgttatccccatggtcacacaaatagccatgaccgataccacaccctttggacaacagagagtgtttaaagagaaagttgacacgcgcacaccaagagcaaaacgaggcacaacacaaattatggaggtgacagccaagtggttgtggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaactaggagagtttggaaaggcaaaaggaagccgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccagggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatctagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgcaacagccttaacagctctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaattcatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcccgaaggggcactctggtaa

SEQ ID NO: 5600 - RNA, 9879 nt, synthetic construct
  misc_feature 1..9879: note = derived and/or modified CDS sequence (wt) from DENV-1__FJ639740__SS-prME
  source 1..9879: mol_type = other RNA
tccgtgaccatgctcctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgctataggaacatccatcactcagaaagggatcattttcatcttgctgatgctggtgacaccatcaatggccatgcgatgtgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgcttgtggacagaggctggggtaatggctgcggactattcggaaagggaagtctattgacgtgtgccaagttcaagtgtgtgacaaaactagaaggaaagatagttcaatatgaaaacttgaaatattcagtgatagtcactgtccacactggggaccagcaccaggtgggaaacgagaccacagaacatggaacaattgcaaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccatggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagactaaaaatggataaactgactttaaaggggatgtcatatgtgatgtgcacaggctcatttaagctagagaaggaagtggctgagacccagcatggaactgttctagtgcaggtcaaatacgaaggaacagacgcgccatgcaagatcccctttgcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagaaaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgttcagcggtgtttcttggaccatgaaaataggaatagggattctgctgacatggttgggattaaattcaaggagcacgtcactttcgatgacgtgcattgcagttggcatggtcacactgtacctaggagtcatggttcaagcggactcgggatgtgtaatcaactggaagggcagagaacttaaatgtggaagtggcatttttgtcactaatgaagtccacacttggacagagcaatacaaatttcaggctgactccccaaaaagactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaacggaattttggcccaagggaaaaaaatgattaggccacaacccatggaacacaaatactcatggaaaagctggggaaaagctaaaatcataggagcagacatacaaaataccaccttcatcatcgacggcccagacaccccagaatgtcccgatggccaaagagcatggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatcccacactctatggagcaatggagttttggaaagtgaaatgataatcccaaagatatatggaggaccaatatctcagcacaactacagaccagggtatttcacacaaacagcagggccatggcacctaggtaagttggaactggattttgacttgtgtgaaggtaccacagttgttgtggatgaacattgtggaaatcgaggtccatctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttactgtctctgacatttgtcaaaacaactctttcattggattatgcatggaaaacaacggctatggtactgtcaatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttgggcaggtcccaagtaggagtgggagtcttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggcgaagttggagccatagctctagatttcaaacccggcacatctggatctcccattgtgaacagagagggaaaaatagtgggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcaggaaaaacaagaagatatcttccagccatagtccgtgaggccataaaaagaaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgattttccaggtaaaacagtctggtttgttccaagcatcaaatcaggaaatgacattgccaactgtttaagaaagaacggaaaacgggtaatccaattgagcagaaaaacctttgacactgagtaccagaaaacaaaaaacaatgactgggattatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggatgccagaacatactctgatccactggccctgcgcgagtttaaagagtttgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtctagggaaaacatctattggcttgctctgtgtgacggcctcaagcgcactgttatggatggccagtgtggagccccactggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaatcaccaacatgctacaatgctggacgtagacctacgcccagcttcagcctggaccctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactagctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaaggaaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggaagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaaggttttgggatctcgtgcacagagagagggagcttcataaacagggaaagtgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggagggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgaccagagaggaagtggacaggtcggaacttatggcttaaatactttcaccaatatggaggtccaactaataagacaaatggagtctgaaggaatctttttacccagcgaattggaaacccccaacctagctgagagagttcttgactggttggaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccacagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatatctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcccgaaggagcactctggtaa

SEQ ID NO: 5601 - RNA, 9879 nt, synthetic construct
  misc_feature 1..9879: note = derived and/or modified CDS sequence (wt) from DENV-1__FJ639741__SS-prME
  source 1..9879: mol_type = other RNA
tccgtgaccatactcctcatgctgctgcccacagccctggcgttccatttgaccacacgagggggagagccacacatgatagttagtaagcaggaaagaggaaagtcactcttgtttaagacctctgcaggtgtcaacatgtgcactctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcacccagaaagggatcattttcattttgctgatgctggtgacaccatcaatggccatgcgatgtgtgggaataggcaatagagacttcgttgaaggactgtcaggagcaacgtgggtggacgtggtattggagcatggaagctgcgtcaccaccatggcaaaaaataaaccaacattggacattgaactcttgaagacggaagtcacgaaccctgccgtcttgcgcaaactgtgcattgaagccaaaatatcaaacaccaccaccgattcaagatgtccaacacaaggagaggctacactggtggaagaacaagacgcgaactttgtgtgtcgccgaacgtttgtggacagaggctggggtaatggctgcggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcaaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcggggacttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacacctgaaatgcagactaaaaatggataaactgactttaaagggaacgtcatatgtgatgtgcacaggctcatttaagctagagaaggaagtggctgagacccagcatggaactgttttagtgcaggtcaaatacgaaggaacagacgcgccatgcaagatccccttttcgacccaagatgagaaaggagtgacccagaatgggagattgataacagccaatcctatagttactgacaaagaaaaaccagtcaacattgagacagaaccaccttttggtgagagctacatcgtggtaggggcaggtgaaaaagctttgaaactaagctggttcaagaaaggaagcagcatagggaaaatgttcgaagcaaccgcccgaggagcacgaaggatggctatcctgggagacaccgcatgggacttcggctctataggaggagtgttcacatctgtgggaaaattggtacaccaggtttttggaaccgcatatggggttctgttcagcggtgtttcttggaccatgaaaataggaatagggattctgctgacatggttgggattaaattcaaggagcacgtcactttcgatgacgtgcattgcagttggcatggttacactgtacctaggagtcatggttcaagcggactcgggatgtgtaatcaactggaagggcagagaactcaaatgtggaagtggcatttttgtcactaatgaagtccatacttggacagagcaatacaagttccaggctgactccccaaaaagactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgattaggccacagcccatggaacacaaatactcatggaaaagctggggaaaagctaaaatcataggagcagacatacaaaataccaccttcatcatcgacggcccagataccccagaatgccccgatgaccaaagagcgtggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaaactggcgaaagcctccttcatagaagtcaagacatgcatctggccgaaatcccacactctatggagcaatggagttttggaaagtgaaatgataattccaaagatatatggaggaccaatatctcagcacaactatagaccagggtatttcacacaaacagcagggccatggcacctaggcaagttggaattggattttgacttgtgtgaaggtaccacagttgttgtggatgaacattgtggaaatcgaggtccatctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttctcataatgggacaactgacatggaatgatctgattaggttatgcatcatggttggagctaatgcttcagacaggatggggatgggaacaacgtacctagccttgatggccactttcaaaatgagaccaatgtttgctgttgggctattatttcgcagactaacatccagagaagttcttcttctcacgattggattaagcctggtggcatccgtggagctaccaaattctttggaggagctaggggatggacttgcaatgggtatcatgatgttaaaattattgactgaatttcagccacaccagttatggaccaccttactgtctctgacatttatcaaaacaactctttcattggattatgcatggaaaacaacggctatggtactgtcaattgtatctctctttcctttatgcctgtctacgacctcccaaaaaacaacatggcttccggtgctgttaggatcttttggatgcaaaccactaaccatgtttcttataacagaaaacaaaatctggggaaggaaaagttggcccctcaatgaaggaattatggctattggaatagtcagcattctactaagttcactcctcaaaaatgatgtgccgttggccggcccactaatagctggaggcatgctaatagcgtgttatgtcatatccggaagctcagccgatttatcattggagaaagcggctgaggtgtcctgggaacaagaagcagaacactccggtacctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggacttgatctcatacggaggaggttggaggtttcaaggatcatggaacacgggagaagaagtgcaggtaatagctgttgaaccaggaaaaaaccccaaaaatgtacagacaacgccgggtaccttcaagactcctgaaggtgaagttggagccatagctctagattttaaacccggcacatctgggtctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttgacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattattatggatgaagcacattttaccgatccagccagcatagcggccagagggtacatctcaacccgagtgggtatgggtgaagcagctgcgatcttcatgacagccactcccccaggatcggtggaggcctttccacagagcaatgcagttatccaagatgaggaaagagacattcctgagagatcatggaattcaggctacgactggatcactgattttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggcccagagcgtgtcattctagctggaccgatgccagtgactgtggccagtgctgcccagaggagaggaagaattggaaggaaccaaaacaaggaaggtgatcagtatgtctacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcgaggagaagcaaggaaaacattcgtggagctcatgagaagaggagatctaccagtttggctatcctacaaagtagcctcagaaggtttccagtactccgacagaaggtggtgctttgatggagaaaggaacaaccaggtgttggaggagaacatggacgtggagatctggacaaaggaaggagaaagaaagaaattgcgaccccgctggttggatgccagaacatactctgatccactggccctgcgcgagtttaaagagtttgcagcaggaagaagaagtgtctcaggtgacctaatattggaaatagggaaacttccacaacatttgacgctaagagcccagaatgctctggataacttggtcatgttgcacaactccgaacaaggaggaaaagcctatagacatgctatggaggaactaccagacactatagaaacattgatgcttctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttctttctgatggtgctgctcattccagagccagacagacagcgcactccacaggacaaccagttagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggactctttatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggatcgttgcaatagacttggatcctgtggtttatgatgcaaaatttgaaaaacagctaggccaaataatgttactgatactttgtacatcacagatcctcttgatgcgaaccacatgggccttgtgtgaatccatcacactggctaccggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagaaaaatggaaaagacagttaaaccaactgagcaagtcagaattcaacacctacaaaaggagtgggattatggaggtggacaggtccgaagccaaagagggactgaaaagaggagaaacaactaaacatgcagtgtcgagaggaacagccaaactgaggtggtttgtggagaggaacctcgtgaaaccagaaggaaaagtcatagacctcggttgtggaagaggtggctggtcatattattgtgctgggctgaagaaagtcactgaagtgaaaggatacacaaaaggaggacttggacatgaggaacccatcccaatggcgacctatggatggaacctagtgaagctacactctggaaaagatgtattttttatgccacctgagaaatgtgacacccttctgtgtgatattggtgagtcctctccgaacccaactatagaagaaggaagaacgttacgtgttctaaagatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttgctgaatcgattcacaatggctcacaggaagccaacatatgaaagagacgtggacttaggcgctggaacaagacatgtcgcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgaaattgctcacaaaaccatgggatgtcatccccatggtcacacaaatagctatgactgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttggaatctcgtgcacagagagagggagcttcataaacagggaaaatgtgccacgtgtgtctacaacatgatggggaagagagagaaaaagttaggagagtttggaaaagcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccggggggaaacatgtatgcagatgatacagccggatgggacacaagaataacagaggatgatcttcagaatgaggctaaaatcactgacatcatggagcctgaacatgctctattggctacgtcaatttttaagctgacttatcaaaataaggtggtgagggtgcaaagaccagcaaaaaatggaaccgtgatggatgttatatccagacgtgaccagagaggaagtggacaggtcggaacatatggcttaaatactttcactaatatggaggtccaactaataagacaaatggagtctgaaggaatctttttacccagcgaactggaaacccccaatctagctgagagagtccttgactggttggaaaaacatggcgccgaaaggctgaaaagaatggcaatcagcggagatgattgcgtggtgaaaccaattgacgacaggttcgcaacagccttaacagctctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcaactgatgtacttccacaggagagacctgagactagcggctaacgctatctgttcagccgtcccagttgattgggtcccaaccagccgtacaacctggtcaatccatgcccaccaccaatggatgacaacagaagacatgttatcagtgtggaatagggtttggatagaggaaaacccatggatggaggacaaaactcatgtatctagttgggaagaagttccatacctagggaaaagggaagatcaatggtgtggatccctaataggcttgacagcgagggccacctgggccaccaacatacaagtagccataaaccaagtgagaaggctcatcgggaatgagaattatctagattacatgacatcaatgaagaggttcaagaatgagagtgatcccgaaggggcactctggtaa

SEQ ID NO: 5602 - RNA, 9879 nt, synthetic construct
  misc_feature 1..9879: note = derived and/or modified CDS sequence (wt) from DENV-1__FJ639743__SS-prME
  source 1..9879: mol_type = other RNA
tccgtgaccatgctcctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatggccctttttttagcacatgctataggaacatccatcactcagaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgcggactattcggaaagggaagtctattgacgtgtgccaagttcaagtgtgtgacaaaactagaaggaaagatagttcaatatgaaaacttaaaatattcagtgatagtcactgtccacactggggaccagcaccaggtgggaaacgagaccacagaacatggaacaattgcaaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccatggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagactaaaaatggataaactgactttaaaggggatgtcatatgtgatgtgcacaggctcatttaagctagagaaggaagtggctgagacccagcatggaactgttctagtgcaggtcagatacgaaggaacagacgcgccatgcaagatccccttttcgacccaagatgagaaaggagtgacccagaatgggagattgataacagccaatcctatagttactgacaaagaaaaaccagtcaacattgagacagaaccaccttttggtgagagctacatcgtggtaggggcaggcgaaaaagctttgaaactaagctggttcaagaaaggaagcagcatagggaaaatgttcgaagcaaccgcccgaggagcacgaaggatggccatcctgggagacaccgcatgggacttcggttctataggaggagtgtttacatctgtgggaaaattggtacaccaggtttttggaaccgcatatggggttctgttcagcggtgtttcttggaccatgaaaataggaatagggattctgctgacatggttgggattaaattcaaggagcacgtcactttcgatgacgtgcattgcagttggcatggtcacactgtacctaggagtcatggttcaagcggactcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtgggagatgctaacggaattttggcccaaggaaaaaaaatgattaggccacaacccatggaacacaaatactcatggaaaagctggggaaaagctaaagtcataggagcagacatacaaaataccaccttcatcatcgacggcccagacaccccagaatgtcccgatggccaaagagcatggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacagcagggccatggcacctaggtaagttggaactggattttgacttgtgtgaaggtaccacagttgttgtggatgaacattgtggaaatcgaggtccatctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttgtaatgggacaactgacatggaatgatctgattaggttatgcatcatggttggagccaatgcttcagacaggatggggatgggaacaacgtacctagccttgatggctactttcaaaatgagaccaatgttcgctgttgggctattattccgcagactaacatccagagaagtccttctcctcacgattggattaagcctggtggcatccgtggagctaccaaattctttggaggagctaggggatggacttgcaatgggtatcatgatgttaaaattgttgactgaatttcagccacaccagttatggaccaccttactgtctctgacatttgtcaaaacaactctttcattggattatgcatggaaaacaacggctatggtactgtcaatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaagcagaacactccggcgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttgggcaggtcccaagtaggagtgggagtcttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaaaaatgtacagacaacgccgggtaccttcaagacttctgaaggcgaagttggagccatagctctagatttcaaacccggcacatctggatcccccattgtgaacagagagggaaaaatagtgggtctttatggaaatggagtggtgacaacaagtggaacctacgttagtgccattgcccaagctaaagcatcacaggaagggcctctaccagagattgaggacgaggtgtttaagaaaagaaacttaacaataatggacctgcacccaggatcaggaaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaattcaggctacgactggattactgattttccaggtagaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggatgccagaacatactctgatccactggccctgcgcgagtttaaagagtttgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtctagggaaaacatctattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgctacaatgctggacgtagacctacgcccagcttcagcctggaccctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggcacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaaggaaaagtcatagacctcggttgtggaagaggtggctggtcatattattgtgctgggctgaagaaagttactgaggtgaagggatacacaaaaggaggacctggacatgaggaacctatcccaatggcgacctatggatggaacctagtaaagctacactctggaaaagatgtattttttatgtcacctgagaaatgtgacacccttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggaagccaacctagatatcattggccagaggatagagaatataagaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgaccagagaggaagtggacaggtcggaacttatggcttaaatactttcaccaacatggaggtccaactaataagacaaatggagtctgaaggaatctttttacccagcgaattggaaacccccaacctagctgagagagttcttgactggttggaaaaacacggcgccgaaaggctgaaacgaatggcaatcagcggagatgattgcgtggtgaaaccaattgacgacaggttcgcaacagccttaacagctctgaatgacatgggaaaagtaagaaaagacataccacagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcccgaaggagcactctggtaa

SEQ ID NO: 5603 - RNA, 9879 nt, synthetic construct
  misc_feature 1..9879: note = derived and/or modified CDS sequence (wt) from DENV-1__FJ639794__SS-prME
  source 1..9879: mol_type = other RNA
tccgtgaccatgctcctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacctgggctttgagacacccaggattcacggtgatagccctttttttagcacatgctataggaacatccatcactcagaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaacggctgcggactattcggaaagggaagtctattgacgtgtgccaagttcaagtgtgtgacaaaactagaaggaaagatagttcaatatgagaacttaaaatattcagtgatagttaccgtccacactggggaccagcatcaggtgggaaacgagaccacagaacatggaacaattgcaaccataacacctcaagctcctacgtcggaaatacagctgaccgactacggagcccttacattggactgctcacctagaacagggctggactttaatgagatggtgctattgacaatgaaagaaaaatcatggcttgtccacaaacaatggtttctagacttaccactgccatggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagactaaaaatggataaactgactttaaaggggatgtcatatgtgatgtgcacaggctcatttaagctagagaaggaagtggctgagacccagcatggaactgttctagtgcaggtcaaatacgaaggaacagacgcgccatgcaagatccccttctcgactcaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagaaaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgttcagcggtgtttcttggaccatgaaaataggaatagggattctgttgacatggttgggattaaattcaaggagcacgtcactttcgatgacgtgcattgtagttggcatggtcacactgtacctaggagtcatggttcaagcggactcgggatgtgtgatcaactggaagggcagagaacttaaatgtggaagtggcatttttgtcactaatgaagtccacacttggacagagcaatacaaattccaggctgactccccaaaaagactgtcagcagccattggaaaggcatgggaggagggagtgtgtggaattcgatcagccacgcgtcttgagaacatcatgtggaagcaaatatcaaatgaattgaaccacattctacttgaaaatgacatgaaattcacagtggttgtaggagatgctaacggaattttggcccaagggaaaaaaatgattaggccacaacccatggaacacaaatactcatggaaaagctggggaaaagccaaaatcataggagcagacatacaaaataccacctttatcatcgacggcccagacaccccagaatgtcccgatggccaaagagcatggaacatttgggaagttgaggactatgggtttggaattttcacgacaaacatatggctgaaattgcgtgactcctacacccaaatgtgtgaccaccggctaatgtcagctgccatcaaggacagcaaggcagttcatgctgacatggggtactggatagaaagtgaaaagaacgaaacctggaagctggcgagagcctccttcatagaagtcaagacatgcacctggccaaaatctcacactctatggagcaatggagttttggaaagtgaaatgataatcccaaagatatatggaggaccaatatctcagcacaactacaggccagggtatttcacacaaacagcagggccatggcacctaggtaagttggaactggattttgacttgtgtgaaggcaccacagttgttgtggatgaacattgtggaaatcgaggtccatctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagattaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttactgtctttgacatttgtcaaaacaactctctcattggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactcctaaaaaatgatgtgccattggccggcccactaatagctggaggcatgctaatagcatgttatgtcatatccggaagctcagccgatttatcattggagaaagcggctgaggtgtcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttgggcaggtcccaagtaggagtgggagtcttccaagacggcgtgttccacacaatgtggcacgtcaccaggggagctgtccttatgtaccaagggaagaggctggaaccaagctgggccagtgtcaaaaaggacttgatctcatatggaggaggttggagatttcaaggatcatggaacacgggagaagaagtgcaggtgatagctgttgaaccaggaaaaaaccccaaaaatgtacagacaacgccgggtaccttcaagactcctgaaggcgaagttggagccatagctctagatttcaaacccggcacatctggatctcccattgtgaacagagagggaaaaatagtgggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcaggaaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaacttaggctacgactggatcactgattttccaggtaaaacagtctggtttgttccaagcattaaatcaggaaatgacattgccaactgtttaagaaagaacggaaaacgggtaatccaactgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattttagccggaccgatgccagtgactgtggccagtgctgcccagagaagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggatgccagaacatactctgatccactggctctgcgcgagtttaaagagtttgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacacgccatggaggaactaccagacaccatagaaacattgatgcttctagctttgatagctgtgttgactggtggagtgacgctattcttcctatcaggaaaaggtttagggaaaacatctattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacacgctacaatgctggacgtagacctacgcccagcttcagcctggaccctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttttcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaaggaaaagtcatagacctcggttgtggaagaggtggctggtcatactattgtgctgggctgaagaaagttactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttctaaaaatggtggaaccatggctcaaaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggttcacaggaagccaacatatgaaagagacgtggacttaggcgctggaacaagacatgtggcagtggaaccagaggtagccaacctagatattattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcggcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccaggggggaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgaccagagaggaagtggacaggtcggaacttatggcttaaatactttcaccaatatggaggtccaactaataagacaaatggagtctgaaggaatctttttacccagcgaattggaaactcccaacctagctgagagagttcttgactggttggaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggagccttcaaaaggatggaatgattggcagcaagtgcctttctgttcacaccatttccaccagctggtcatgaaggatgggagggaaatagtggtgccatgccgcaaccaagatgaacttgtgggcagggccagagtatcgcaaggcgccggatggagcctgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcctgaaggagcactctggtaa

SEQ ID NO: 5604 - RNA, 9879 nt, synthetic construct
  misc_feature 1..9879: note = derived and/or modified CDS sequence (wt) from DENV-1__FJ639796__SS-prME
  source 1..9879: mol_type = other RNA
tccgtgaccatgctcctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacctgggctttgagacacccaggattcacggtgatagccctttttttagcacatgctataggaacatccatcactcagaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaacggctgcggactattcggaaagggaagtctattgacgtgtgccaagttcaagtgtgtgacaaaactagaaggaaagatagttcaatatgagaacttaaaatattcagtgatagttaccgtccacactggggaccagcatcaggtgggaaacgagaccacagaacatggaacaattgcaaccataacacctcaagctcctacgtcggaaatacagctgaccgactacggagcccttacattggactgctcacctagaacagggctggactttaatgagatggtgctattgacaatgaaagaaaaatcatggcttgtccacaaacaatggtttctagacttaccactgccatggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagactaaaaatggataaactgactttaaaggggatgtcatatgtgatgtgcacaggctcattcaagctagagaaggaagtggctgagacccagcatggaactgttctagtgcaggtcaaatacgaaggaacagacgcgccatgcaagatccccttctcgactcaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagaaaggaagcagcatagggaaaatgttcgaagcaaccgcccgaggagcacgaaggatggctatcctgggagacaccgcatgggacttcggttctataggaggagtgtttacatctgtgggaaaattggtacatcaggtttttggaaccgcatatggggttctgttcagcggtgtttcttggaccatgaaaataggaatagggattctgttgacatggttgggattaaattcaaggagcacgtcactttcgatgacgtgcattgcagttggcatggtcacactgtacctaggagtcatggttcaagcggactcgggatgtgtgatcaactggaagggcagagaacttaaatgtggaagtggcatttttgtcactaatgaagtccacacttggacagagcaatacaaattccaggctgactccccaaaaagactgtcagcagccattggaaaggcatgggaggagggagtgtgtggaattcgatcagccacgcgtcttgagaacatcatgtggaagcaaatatcaaatgaattgaaccacattctacttgaaaatgatatgaaattcacagtggttgtaggagatgctaacggaattttggcccaaggaaaaaaaatgattaggccacaacccatggaacacaaatactcatggaaaagctggggaaaagctaaaatcataggagcagacatacaaaataccacctttatcatcgacggcccagacaccccagaatgtcccgatggccaaagagcatggaacatttgggaagttgaggactatgggtttggaattttcacgacaaacatatggctgaaattgcgtgactcctacacccaaatgtgtgaccaccggctaatgtcagctgccatcaaggacagcaaggcagttcatgctgacatggggtactggatagaaagtgaaaagaacgaaacctggaagctggcgagagcctccttcatagaagtcaagacatgcacctggccaaaatctcacactctatggagcaatggagttttggaaagtgaaatgataatcccaaagatatatggaggaccaatatctcagcacaactacaggccagggtatttcacacaaacagcagggccatggcacctaggtaagttggaactggattttgacttgtgtgaaggcaccacagttgttgtggatgaacattgtggaaatcgaggtccatctctcagaactacaacagtcacaggaaagataatccatgaatggtgttgcagatcctgcacgttaccccccttgcgtttcagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagattaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttactgtctttgacatttgtcaaaacaactctctcattggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactcctaaaaaatgatgtgccattggccggcccactaatagctggaggcatgctaatagcatgttatgtcatatccggaagctcagccgatttatcattggagaaagcggctgaggtgtcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttgggcaggtcccaagtaggagtgggagtcttccaagacggcgtgttccacacaatgtggcatgtcaccaggggagctgtccttatgtaccaagggaaaaggctggaaccaagctgggccagtgtcaaaaaggacttgatctcatatggaggaggttggagatttcaaggatcatggaacacgggagaagaagtgcaggtgatagctgttgaaccaggaaaaaaccccaaaaatgtacagacaacgccgggtaccttcaagactcctgaaggcgaagttggagccatagctctagatttcaaacccggcacatctggatctcccattgtgaacagagagggaaaaatagtgggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcaggaaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctactttcaccatgcgtcttttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgttccaagcattaaatcaggaaatgacattgccaactgtttaagaaagaacggaaaacgggtaatccaactgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagagaagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggatgccagaacatactctgatccactggctctgcgcgagtttaaagagtttgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacacgctatggaggaactaccagacaccatagaaacattgatgcttctagctttgatagctgtgttgactggtggagtgacgctattcttcctatcaggaaaaggtttagggaaaacatctattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacacgctacaatgctggacgtagacctacgcccagcttcagcctggaccctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttttcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaaggaaaagtcatagacctcggttgtggaagaggtggctggtcatactattgtgctgggctgaagaaagttactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttctaaaaatggtggaaccatggctcaaaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatattattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcggcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccagggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgaccagagaggaagtggacaggtcggaacttatggcttaaatactttcaccaatatggaggtccaactaataagacaaatggagtctgaaggaatctttttacccagcgaattggaaactcccaacctagctgagagagttcttgactggttggaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggagccttcaaaaggatggaatgattggcagcaagtgcctttctgttcacaccatttccaccagctgatcatgaaggatgggagggaaatagtggtgccatgccgcaaccaagatgaacttgtgggcagggccagagtatcgcaaggcgccggatggagcctgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcctgaaggagcactctggtaa

SEQ ID NO: 5605 - RNA, 9879 nt, synthetic construct
  misc_feature 1..9879: note = derived and/or modified CDS sequence (wt) from DENV-1__FJ639797__SS-prME
  source 1..9879: mol_type = other RNA
tccgtgaccatgctcctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacctgggctttgagacacccaggattcacggtgatagccctttttttagcacatgctataggaacatccatcactcagaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactatgcattgaagctaaaatatcaaacaccaccaccgattcaagatgtccaacacaaggagaggctacactggtggaagaacaagacgcgaactttgtgtgtcgccgaacgtttgtggacagaggctggggtaacggctgcggactattcggaaagggaagtctattgacgtgtgccaagttcaagtgtgtgacaaaactagaaggaaagatagttcaatatgagaacttaaaatattcagtgatagttaccgtccacactggggaccagcatcaggtgggaaacgagaccacagaacatggaacaatcgcaaccataacacctcaagctcctacgtcggaaatacagctgaccgactacggagcccttacattggactgctcacctagaacagggctggactttaatgagatggtgctattgacaatgaaagaaaaatcatggcttgtccacaaacaatggtttctagacttaccactgccatggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacaacaacaatcttcgcaggacacctgaaatgcagactaaaaatggataaactgactttaaaggggatgtcatatgtgatgtgcacaggctcatttaagctagagaaggaagtggctgagacccagcatggaactgttctagtgcaggtcaaatacgaaggaacagacgcgccatgcaagatccccttctcgactcaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagaaaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgttcagcggtgtttcttggaccatgaaaataggaatagggattctgttgacatggttgggattaaattcaaggagcacgtcactttcgatgacgtgcattgcagttggcatggtcacactgtacctaggagtcatggttcaagcggactcgggatgtgtgatcaactggaagggcagagaacttaaatgtggaagtggcatttttgtcactaatgaagtccacacttggacagagcaatataaattccaggctgactccccaaaaagactgtcagcagccattggaagggcatgggaggagggagtgtgtggaattcgatcagccacgcgtcttgagaacatcatgtggaagcaaatatcaaatgaattgaaccacattctacttgaaaatgacatgaaattcacagtggttgtaggagacgctaacggaattttggcccaagggaagaaaatgattaggccacaacccatggaacacaaatactcatggaaaagctggggaaaagctaaaatcataggagcagacatacaaaataccacctttatcatcgacggcccagacaccccagaatgtcccgatggccaaagagcatggaacatttgggaagttgaggactatgggtttggaattttcacgacaaacatatggctgaaattgcgtgactcctacacccaaatgtgtgaccaccggctaatgtcagctgccatcaaggacagcaaggcagttcatgctgacatggggtactggatagaaagtgaaaagaacgaaacctggaagctggcgagagcctccttcatagaagtcaagacatgcatctggccaaaatctcacactctatggagcaatggagttttggaaagtgaaatgataatcccaaagatatatggaggaccaatatctcagcacaactacaggccagggtatttcacacaaacagcagggccatggcacctaggtaagttggaactggattttgacttgtgtgaaggcaccacagttgttgtggatgaacattgtggaaatcgaggtccatctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagattaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttactgtctttgacatttgtcaaaacaactctctcattggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactcctaaaaaatgatgtgccattggccggcccactaatagctggaggcatgctaatagcatgttatgtcatatccggaagctcagccgatttatcattggagaaagcggctgaggtgtcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttgggcaggtcccaagtaggagtgggagtcttccaagacggcgtgttccacacaatgtggcacgtcaccaggggagctgtccttatgtaccaagggaagaggctggaaccaagctgggccagtgtcaaaaaggacttgatctcatatggaggaggttggagatttcaaggatcatggaacacgggagaagaagtgcaggtgatagctgttgaaccaggaaaaaaccccaaaaatgtacagacaacgccgggtaccttcaagactcctgaaggcgaagttggagccatagctctagatttcaaacccggcacatctggatctcccattgtgaacagagagggaaaaatagtgggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcaggaaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgcgtcattctagccggaccgatgccagtgactgtggccagtgctgcccagagaagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggatgccagaacatactctgatccactggctctgcgcgagtttaaagagtttgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacacgctatggaggaactaccagacaccatagaaacattgatgcttctagctttgatagctgtgttgactggtggagtgacgctattcttcctatcaggaaaaggtttagggaaaacatctattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatattgacagtggcagccaatgagatgggattattggaaaccacaaagaaagacctggggattggctatgtagccgccgaaaaccaccaacacgctacaatgctggacgtagacctacgcccagcttcagcctggaccctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgctactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttttcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaacaaaacatgcagtgtcgagaggaacagccaaactgaggtggtttgtggagaggaacctcgtgaaaccagaaggaaaagtcatagacctcggttgtggaagaggtggctggtcatactattgtgctgggctgaagaaagttactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttctaaaaatggtggaaccatggctcaaaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtatcggcagtgaacatgacatccagaatgttactgaaccgattcacaatggctcacaggaagccaacatatgaaagagacgtggacttaggcgctggaacaagacatgtggcagtggaaccagaggtagccaacctagatattattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcggcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctagagttcgaagcccttggtttcatgaatgaagatcactggtttagtagagagaattcactcagtggagtggaaggagaaggactgcacaaacttggatacatactcagagacatatcaaagattccagggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgaccagagaggaagtggacaggtcggaacttatggcttaaatactttcaccaatatggaggtccaactaataagacaaatggagtctgaaggaatctttttacccagcgaattggaaactcccaacctagctgagagagttcttgactggttggaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggagccttcaaaaggatggaatgattggcagcaagtgcctttctgttcacaccatttccaccagctgatcatgaaggatgggagggaaatagtggtgccatgccgcaaccaagatgaacttgtgggcagggccagagtatcgcaaggcgccggatggagcctgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcctgaaggagcactctggtaa

SEQ ID NO: 5606 - RNA, 9879 nt, synthetic construct
  misc_feature 1..9879: note = derived and/or modified CDS sequence (wt) from DENV-1__FJ639802__SS-prME
  source 1..9879: mol_type = other RNA
tccgtgactatgctcctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacctgggctttaagacacccaggattcacggtgatagccctttttttagcacatgctataggaacatccatcactcagaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggtaacggctgcggactattcggaaagggaagtctattgacgtgtgccaagttcaagtgtgtgacaaaactagaaggaaagatagttcaatatgagaacttaaaatattcagtgatagttaccgtccacactggggaccagcatcaggtgggaaacgagaccacagaacatggaacaattgcaaccataacacctcaagctcctacgtcggaaatacagctgaccgactacggagcccttacattggactgctcacctagaacagggctggactttaatgagatggtgctattgacaatgaaagaaaaatcatggcttgtccacaaacaatggtttctagacttaccactgccatggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagactaaaaatggataaactgactttaaaggggatgtcatatgtgatgtgcacaggctcatttaagctagagaaggaagtggctgagacccagcatggaactgttctagtgcaggtcaaatacgaaggaacagacgcgccatgcaagatccccttctcgactcaagatgagaaaggagtgacccagaatgggagattgataacagccaatcccatagttactgacaaagaaaaaccagtcaacattgagacagaaccaccttttggtgagagctacatcgtggtaggggcaggcgaaaaagccttgaaactaagctggttcaagaaaggaagcagcatagggaaaatgtttgaagcaaccgcccgaggagcacgaaggatggctatcctgggagacaccgcatgggacttcggttctataggaggagtgtttacatctgtgggaaaattggtacaccaggtttttggaaccgcatatggggttctgttcagcggtgtttcttggaccatgaaaataggaatagggattctgttgacatggttgggattaaattcaaggagcacgtcactttcgatgacgtgcattgcagttggcatggtcacactgtacctaggagtcatggttcaagcggactcgggatgtgtgatcaactggaagggcagagaacttaaatgtggaagtggcatttttgtcactaatgaagtccacacttggacagagcaatacagattccaggctgactccccaaaaagactgtcagcagccattggaaaggcatgggaggagggagtgtgtggaattcgatcagccacgcgtcttgagaacatcatgtggaagcaaatatcaaatgaattgaaccacattctacttgaaaatgatatgaaattcacagtggttgtaggagatgctaacggaattttggcccaagggaaaaaaatgattaggccacaacccatggaacacaaatactcatggaaaagctggggaaaagctaaaatcataggagcagacatacaaaataccacctttatcatcgacggcccagacaccccagaatgtcccgatggccaaagagcatggaacatttgggaagttgaggactatgggtttggaattttcacgacaaacatatggctgaaattgcgtgactcctacacccaaatgtgtgaccaccggctaatgtcagctgccatcaaggacagcaaggcagttcatgctgacatggggtactggatagaaagtgaaaagaacgaaacctggaagctggcgagagcctccttcatagaagtcaagacatgcatctggccaaaatctcacactctatggagcaatggagttttggaaagtgaaatgataatcccaaagatatatggaggaccaatatctcagcacaactacaggccagggtatttcacacaaacagcagggccatggcacctaggtaagttggaactggattttgacttgtgtgaaggcaccacagttgttgtggatgaacattgtggaaatcgaggtccatctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagattaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttactgtctttgacatttgtcaaaacaactctctcattggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactcctaaaaaatgatgtgccattggccggcccactaatagctggaggcatgctaatagcatgttatgtcatatccggaagctcagccgatttatcattggagaaagcggctgaggtgtcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttgggcaggtcccaagtaggagtgggagtcttccaagacggcgtgttccacacaatgtggcacgtcaccaggggagctgtccttatgtaccaagggaagaggctggaaccaagctgggccagtgtcaaaaaggacttgatctcatatggaggaggttggagatttcaaggatcatggaacacgggagaagaagtgcaggtgatagctgttgaaccaggaaaaaaccccaaaaatgtacagacaacgccgggtaccttcaagactcctgaaggcgaagttggagccatagctctagatttcaaacccggcacatctggatctcccattgtgaacagagagggaaaaatagtgggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcaggaaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcggtgaagagtgaacacacaggaagggagatagttgacctcatgtgccacgctacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgttccaagcattaaatcaggaaatgacattgccaactgtttaagaaagaacggaaaacgggtaatccaactgagcagaaaaacctttgacactgagtaccagaaaacaaaaaacaatgactgggactatgttgtcacaacagacatttccgaaatgggggctaatttccgggccgacagggtaatagacccaaggcggtgcttgaaaccggtaatactaaaagatggtccagagcgtgtcattctagccggaccgatgccagtgactgtggccagtgctgcccagagaagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggatgccagaacatactctgatccactggctctgcgcgagtttaaagagtttgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacacgctatggaggaactaccagacaccatagaaacattgatgcttctagctttgatagctgtgttgactggtggagtgacgctattcttcctatcaggaaaaggtttagggaaaacatctattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacacgctacaatgctggacgtagacctacgcccagcttcagcctggaccctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttttcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagctaaactgaggtggtttgtggagaggaacctcgtgaaaccagaaggaaaagtcatagacctcggttgtggaagaggtggctggtcatactattgtgctgggctgaagaaagttactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttctaaaaatggtggaaccatggctcaaaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatattattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcggcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccagggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgaccagagaggaagtggacaggtcggaacttatggcttaaatactttcaccaatatggaggtccaactaataagacaaatggagtctgaaggaatctttttacccagcgaattggaaactcccaacctagctgagagagttcttgactggttggaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggagccttcaaaaggatggaatgattggcagcaagtgcctttctgttcacaccatttccaccagctgatcatgaaggatgggagggaaatagtggtgccatgccgcaaccaagatgaacttgtgggcagggccagagtatcgcaaggcgccggatggagcctgagagaaactgcttgcctaggcaagtcatatgcacaaatgtggcagctgatgtacttccacaggagagacctgagactagcggctaacgctatctgttcagctgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcctgaaggagcactctggtaa

SEQ ID NO: 5607 - RNA, 9879 nt, synthetic construct
  misc_feature 1..9879: note = derived and/or modified CDS sequence (wt) from DENV-1__JN819410__SS-prME
  source 1..9879: mol_type = other RNA
tccgtgaccatgctcctcatgctgctgcccacagccctggcgtttcatttgaccacacgagggggagagccacacatgatagttagtaagcaggaaagaggaaagtcactcttgtttaagacctctgcgggcgtcaatatgtgcaccctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggaaacaaatacaaagagtggaaacttgggctttgagacacccaggattcacggtgatagccttttttttagcacatgctataggaacatccatcactcaaaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgcttgtggacagaggctggggtaatggctgcggactattcggaaagggaaatctattgacgtgtgccaagttcaagtgtgtgacaaaactagaaggaaagatagttcaatatgaaaacttaaaatattcagtgatagtcactgtccacactggggaccagcaccaggtgggaaacgagaccacagaacatggaacaattgcaaccataacacctcaagctcccacgtcggaaatacagctgaccgactacggagccctcacattggactgctcacctagaacagggctggactttaatgagatggtgctattgacaatgaaagaaaaatcatggcttgtccacaaacaatggtttctagacttaccactgccatggacttcgggggcttcaacatctcaagagacctggaacagacaagatttgctggtcacattcaagacagctcatgcaaagaaacaggaagtagtcgtactgggatcacaggaaggagcaatgcacacagcgttgactggggcgacagaaatccagacgtcaggaacgacaacaatcttcgcaggacacctgaaatgcagactaaaaatggataaactgaccttaaaggggatgtcatatgtgatgtgcacaggctcatttaagctagagaaggaagtggctgagacccagcatggaactgttctagtgcaggtcaaatatgaaggaacagatgcgccatgcaagatccccttttcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgtttagcggtgtttcttggaccatgaaaataggaatagggattctgctgacatggttgggattaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtgtgtggaattcgatcagccacgcgtcttgagaacatcatgtggaagcaaatatcaaatgaattgaaccacattctacttgagaatgacatgaaattcacagtggttgtaggagatgccaacggaattttggcccaaggaaaaaaaatgattaggccacaacccatggaacacaaatactcatggaaaagctggggaaaagctaaaatcataggagcagacatacaaaatactaccttcatcatcgacggcccagacaccccagaatgtcccgatggccaaagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacagcagggccatggcacctaggtaagttggaactggattttgacttgtgtgaaggtaccacagttgttgtggatgaacattgtggaaatcgaggtccatctctcagaaccacaacagtcacaggaaagataatccatgaatggtgttgcagatcctgcacgctaccccccttacgtttcagaggagaagacgggtgttggtatggcatggaaatcagaccagtaaaggagaaggaggagaatctagtcaggtcaatggtctctgcagggtcaggagaagtggatagtttttcattaggaatactatgcgtgtcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttattgtctctgacatttatcaaaacaactctctcactggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagctcactcctcaaaaatgatgtgccgttggccgggccactaatagctggaggcatgctaatagcatgttatgtcatatccggaagctcagccgatttatcattggagaaagcggctgaagtatcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttggggaggtcccaagtaggagtgggagtcttccaagacggcgtgttccacacaatgtggcacgttaccaggggagctgtccttatgtaccaagggaagagactggaaccaagctgggccagtgtcaaaaaggacttgatctcatatggaggaggttggaggttccaaggatcatggaacacaggagaagaagtgcaggtgatagctgttgaaccaggaaaaaaccccaaaaatgtacagacaacgccgggcaccttcaagactcctgaaggcgaagttggagccatagctctagatttcaaacccggcacatctggatctcccattgtgaacagagagggaaaaatagtgggtctgtatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcagggaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctttttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggacgccagaacatactctgatccattggccctgcgcgagtttaaagagttcgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgctacaatgctggacgtagacctacacccagcttcagcctggaccctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatctatcacactggctactggacccctgaccactctctgggagggatctccaggaaaattctggaataccacaatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaagctacactctggaaaggatgtattttttatgccacctgagaaatgtgacacccttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacagattatggaggtgacagccaagtggttatggggtttcctttccagaaacaaaaaacccagaatctgcacaagagaggagttcacaagaaaggttaggtcgaacgcggcaataggagcagtgttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgatcagagaggaagtggacaggtcggaacttatggcttaaatactttcaccaatatggaggtccaactaataagacaaatggagtctgaaggaatctttttacccagcgaattggaaacccccaacctagctgagagggctcttgactggttagaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcaaaaggatggaatgattggcagcaagtgcctttttgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctaggaaaaagggaagaccaatggtgtggatccctgataggcttgacagcgagggccacctgggccaccaacatacaagtagccataaaccaagtgagaaggctcatcgggaatgagaattatttagattacatgacatcaatgaagagattcaagaatgagagtgatcccgaaggagcactctggtaa

SEQ ID NO: 5608 - RNA, 9879 nt, synthetic construct
  misc_feature 1..9879: note = derived and/or modified CDS sequence (wt) from DENV-1__FJ639806__SS-prME
  source 1..9879: mol_type = other RNA
tccgtgaccatgctcctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacctgggctttgagacacccaggattcacggtgatagccctttttttagcacatgctataggaacatccatcactcagaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactatgcattgaagctaaaatatcaaacaccaccaccgattcaagatgtccaacacaaggagaggctacactggtggaagaacaagacgcgaactttgtgtgtcgccgaacgtttgtggacagaggctggggtaacggctgcggactattcggaaagggaagtctattgacgtgtgccaagttcaagtgtgtgacaaaactagaaggaaagatagttcaatatgagaacttaaaatattcagtgatagttaccgtccacactggggaccagcatcaggtgggaaacgagaccacagaacatggaacaatcgcaaccataacacctcaagctcctacgtcggaaatacagctgaccgactacggagcccttacattggactgctcacctagaacagggctggactttaatgagatggtgctattgacaatgaaagaaaaatcatggcttgtccacaaacaatggtttctagacttaccactgccatggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacaacaacaatcttcgcaggacacctgaaatgcagactaaaaatggataaactgactttaaaggggatgtcatatgtgatgtgcacaggctcatttaagctagagaaggaagtggctgagacccagcatggaactgttctagtgcaggtcaaatacgaaggaacagacgcgccatgcaagatccccttctcgactcaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagaaaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgttcagcggtgtttcttggaccatgaaaataggaatagggattctgttgacatggttgggattaaattcaaggagcacgtcactttcgatgacgtgcattgcagttggcatggtcacactgtacctaggagtcatggttcaagcggactcgggatgtgtgatcaactggaagggcagagaacttaaatgtggaagtggcatttttgtcactaatgaagtccacacttggacagagcaatataaattccaggctgactccccaaaaagactgtcagcagccattggaagggcatgggaggagggagtgtgtggaattcgatcagccacgcgtcttgagaacatcatgtggaagcaaatatcaaatgaattgaaccacattctacttgaaaatgacatgaaattcacagtggttgtaggagatgctaacggaattttggcccaagggaagaaaatgattaggccacaacccatggaacacaaatactcatggaaaagctggggaaaagctaaaatcataggagcagacatacaaaataccacctttatcatcgacggcccagacaccccagaatgtcccgatggccaaagagcatggaacatttgggaagttgaggactatgggtttggaattttcacgacaaacatatggctgaaattgcgtgactcctacacccaaatgtgtgaccaccggctaatgtcagctgccatcaaggacagcaaggcagttcatgctgacatggggtactggatagaaagtgaaaagaacgaaacctggaagctggcgagagcctccttcatagaagtcaagacatgcatctggccaaaatctcacactctatggagcaatggagttttggaaagtgaaatgataatcccaaagatatatggaggaccaatatctcagcacaactacaggccagggtatttcacacaaacagcagggccatggcacctaggtaagttggaactggattttgacttgtgtgaaggcaccacagttgttgtggatgaacattgtggaaatcgaggtccatctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagattaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttactgtctttgacatttgtcaaaacaactctctcattggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactcctaaaaaatgatgtgccattggccggcccactaatagctggaggcatgctaatagcatgttatgtcatatccggaagctcagccgatttatcattggagaaagcggctgaggtgtcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttgggcaggtcccaagtaggagtgggagtcttccaagacggcgtgttccacacaatgtggcacgtcaccaggggagctgtccttatgtaccaagggaagaggctggaaccaagctgggccagtgtcaaaaaggacttgatctcatatggaggaggttggagatttcaaggatcatggaacacgggagaagaagtgcaggtgatagctgttgaaccaggaaaaaaccccaaaaatgtacagacaacgccgggtaccttcaagactcctgaaggcgaagttggagccatagctctagatttcaaacccggcacatctggatctcccattgtgaacagagagggaaaaatagtgggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcaggaaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagagaagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggatgccagaacatactctgatccactggctctgcgcgagtttaaagagtttgcagcaggaagaagaagtgtctcaggtgacctaatattggaaatagggaaacttccacaacatttgacgctaagagcccagaatgctctggacaacttggtcatgttgcataattccgaacaaggaggaaaagcctacagacacgctatggaggaactaccagacaccatagaaacattgatgcttctagctttgatagctgtgttgactggtggagtgacgctattcttcctatcaggaaaaggtttagggaaaacatctattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacacgctacaatgctggacgtagacctacgcccagcttcagcctggaccctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgctactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttttcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaacaaaacatgcagtgtcgagaggaacagccaaactgaggtggtttgtggagaggaacctcgtgaaaccagaaggaaaagtcatagacctcggttgtggaagaggtggctggtcatactattgtgctgggctgaagaaagttactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttctaaaaatggtggaaccatggctcaaaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtatcggcagtgaacatgacatccagaatgttactgaaccgattcacaatggctcacaggaagccaacatatgaaagagacgtggacttaggcgctggaacaagacatgtggcagtggaaccagaggtagccaacctagatattattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcggcaataggagcagtgttcgttgacgaaaaccaatggaactcggcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctagagttcgaagcccttggtttcatgaatgaagatcactggtttagtagagagaattcactcagtggagtggaaggagaaggactgcacaaacttggatacatactcagagacatatcaaagattccagggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgaccagagaggaagtggacaggtcggaacttatggcttaaatactttcaccaatatggaggtccaactaataagacaaatggagtctgaaggaatctttttacccagcgaattggaaactcccaacctagctgagagagttcttgactggttgaaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggagccttcaaaaggatggaatgattggcagcaagtgcctttctgttcacaccatttccaccagctgatcatgaaggatgggagggaaatagtggtgccatgccgcaaccaagatgaacttgtgggcagggccagagtatcgcaaggcgccggatggagcctgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcctgaaggagcactctggtaa

SEQ ID NO: 5609 - RNA, 9879 nt, synthetic construct
  misc_feature 1..9879: note = derived and/or modified CDS sequence (wt) from DENV-1__JN819411__SS-prME
  source 1..9879: mol_type = other RNA
tccgtgaccatgctcctcatgctgctgcccacagccctggcgttccatttgaccacacgagggggagagccacacatgatagttagcaagcaggaaagaggaaagtcactcttgtttaagacctctgcaggtgtcaatatgtgcactctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacatcgacgagacaaacgttccgtggcactggccccacacgtgggacttggtctagaaacaagaaccgaaacatggatgtcctctgaaggcgcctggaaacaaatacaaagagtggagacctgggctttgagacacccaggattcacggtgatagccctttttttagcacatgctataggaacatccatcactcagaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaacggctgcggactattcggaaagggaagtctattgacgtgtgccaagttcaagtgtgtgacaaaactagaaggaaagatagttcaatatgagaacttaaaatattcagtgatagttaccgtccacactggggaccagcatcaggtgggaaacgagaccacagaacatggaacaattgcaaccataacacctcaagctcctacgtcggaaatacagctgaccgactacggagcccttacattggactgctcacctagaacagggctggactttaatgagatggtgctattgacaatgaaagaaaaatcatggcttgtccacaaacaatggtttctagacttaccactgccatggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagactaaaaatggataaactgactttaaaggggatgtcatatgtgatgtgcacaggctcattcaagctagagaaggaagtggctgagacccagcatggaactgttctagtgcaggtcaaatacgaaggaacagacgcgccatgcaagatccccttctcgactcaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagaaaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgttcagcggcgtttcttggaccatgaaaataggaatagggattctgttgacatggttgggattaaattcaaggagcacgtcactttcgatgacgtgcattgcagttggcatggtcacactgtacctaggagtcatggttcaagcggactcgggatgtgtgatcaactggaagggcagagaacttaaatgtggaagtggcatttttgtcactaatgaagtccacacttggacagagcaatacaaattccaggctgactccccaaaaagactgtcagcagccattggaaaggcatgggaggagggagtgtgtggaattcgatcagccacgcgtcttgagaacatcatgtggaagcaaatatcaaatgaattgaaccacattctacttgaaaatgatatgaaattcacagtggttgtaggagatgctaacggaattttggcccaagggaaaaaaatgattaggccacaacccatggaacacaaatactcatggaaaagctggggaaaagctaaaatcataggagcagacatacaaaataccacctttatcatcgacggcccagacaccccagaatgtcccgatggccaaagagcatggaacatttgggaagttgaggactatgggtttggaattttcacgacaaacatatggctgaaattgcgtgactcctacacccaaatgtgtgaccaccgactaatgtcagctgccatcaaggacagcaaggcagttcatgctgacatggggtactggatagaaagtgaaaagaacgaaacctggaagctggcgagagcctccttcatagaagtcaagacatgcacctggccaaaatctcacactctatggagcaatggagttttggaaagtgaaatgataatcccaaagatatatggaggaccaatatctcagcacaactacaggccagggtatttcacacaaacagcagggccatggcacctaggtaagttggaactggattttgacttgtgtgaaggcaccacagttgttgtggatgaacattgtggaaatcgaggtccatctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttatagtgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagattaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttactgtctttgacatttgtcaaaacaactctctcattggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactcctaaaaaatgatgtgccattggccggcccactaatagctggaggcatgctaatagcatgttatgtcatatccggaagctcagccgatttatcattggagaaagcggctgaggtgtcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttgggcaggtcccaagtaggagtgggagtcttccaagacggcgtgttccacacaatgtggcatgtcaccaggggagctgtccttatgtaccaagggaagaggctggaaccaagctgggccagtgtcaaaaaggacttgatctcatatggaggaggttggagatttcaaggatcatggaacacgggagaagaagtgcaggtgatagctgttgaaccaggaaaaaaccccaaaaatgtacagacaacgccgggtaccttcaagactcctgaaggcgaagttggagccatagctctagatttcaaacccggcacatctggatctcccattgtgaacagagagggaaaaatagtgggtctttatggaaatggagtggtaacaacaagtggaacctacgtcagtgccattgcccaagctaaagcatcacaggaagggcctctaccagagattgaggacgaggtgtttaagaaaagaaacttaacaataatggacctgcacccaggatcaggaaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgttccaagcattaaatcaggaaatgacattgccaactgtttaagaaagaacggaaaacgggtaatccaactgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagagaagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggatgccagaacatactctgatccactggctctgcgcgagtttaaagagtttgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacacgctatggaggaactaccagacaccatagaaacattgatgcttctagctttgatagctgtgttgactggtggagtgacgctattcttcctatcaggaaaaggtttagggaaaacatctattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacacgctacaatgctggacgtagacctacgcccagcttcagcctggaccctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaagccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttttcattaatgaaatctttaggaggaggtaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaaggaaaagtcatagacctcggttgtggaagaggtggctggtcatactattgtgctgggctgaagaaagttactgaagtgaagggatacacaaaaggaggacctggacatgaggaacccgtcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttctaaaaatggtggaaccatggctcaaaggaaaccaattctgcataaaaatcctaaacccttacatgccaagtgtggtagaaactctggagcaaatgcaaagaaaacatggagggatgctagtgcgaaatccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatattattggccagaggatagagaatataaaaaatgaacacaagttaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacaaattatggaggtgacagccaagtggttatggggtttcctttccagaaacaaaaaacctagaatctgcacaagagaggagttcacaagaaaggttaggtcaaacgcggcaataggagcagtgttcgttgatgaaaaccaatggaactcggcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccagggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgaccagagaggaagtggacaggtcggaacttatggcttaaatactttcaccaatatggaggtccaactaataagacaaatggagtctgaaggaatcttttcacccagcgaattggaaactcccaacctagctgagagagttcttgactggttggaaaaacatggcgccgaaaggctgaaacgaatggcaatcagcggagatgattgcgtggtgaaaccaattgacgacaggttcgcaacagccttaacagctttgaatgacatgggaaaagtaagaaaagacataccgcagtgggagccttcaaaaggatggaatgattggcagcaagtgcctttctgttcacaccatttccaccagctgatcatgaaggatgggagggaaatagtggtgccatgccgcaaccaagatgaacttgtgggcagggccagagtatcgcaaggcgccggatggagcctgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacttgggccaccaacatacaagtagccataaaccaagtgagaaggctcatcgggaatgagaattatctagattacatgacatcaatgaagagattcaagaatgagagtgatcctgaaggagcactctggtaa

SEQ ID NO: 5610 - RNA, 9879 nt, synthetic construct
  misc_feature 1..9879: note = derived and/or modified CDS sequence (wt) from DENV-1__FJ639812__SS-prME
  source 1..9879: mol_type = other RNA
tccgtgaccatgctcctcatgctgttgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacctgggctttgagacacccaggattcacggtgatagccctttttttagcacatgctataggaacatccatcactcagaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaacggctgcggactattcggaaagggaagtctattgacgtgtgccaagttcaagtgtgtgacaaaactagaaggaaagatagttcaatatgagaacttaaaatattcagtgatagttaccgtccacactggggaccagcatcaggtgggaaacgagaccacagaacatggaacaattgcaaccataacacctcaagctcctacgtcggaaatacagctgaccgactacggagcccttacattggactgctcacctagaacagggctggactttaatgagatgatgctattgacaatgaaagaaaaatcatggcttgtccacaaacagtggtttctagacttaccactgccatggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagactaaaaatggataaactgactttaaaggggatgtcatatgtgatgtgcacaggctcattcaagttagagaaggaagtggctgagacccagcatggaactgttctagtgcaggtcaaatacgaaggaacagacgcgccatgcaagatccccttctcgactcaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagaaaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgttcagcggtgtttcttggaccatgaaaataggaatagggattctgttgacatggttgggattaaattcaaggagcacgtcactttcgatgacgtgcattgcagttggcatggtcacactgtacctaggagtcatggttcaagcggactcgggatgtgtgatcaactggaagggcagagaacttaaatgtggaagtggcatttttgtcactaatgaagtccacacttggacagagcaatacaaattccaggctgactccccaaaaagactgtcagcagccattggaaaggcatgggaggagggagtgtgtggaattcgatcagccacgcgtcttgagaacatcatgtggaagcaaatatcaaatgaattgaaccacattctacttgaaaatgatatgaaattcacagtggttgtaggagatgctaacggaattttggcccaagggaaaaaaatgattaggccacaacccatggaacacaaatactcatggaaaagctggggaaaagctaaaatcataggagcagacatacaaaataccacctttatcatcgacggcccagacaccccagaatgtcccgatggccaaagagcatggaacatttgggaagttgaggactatgggtttggaattttcacgacaaacatatggctgaaattgcgtgactcctacacccaaatgtgtgaccaccggctaatgtcagctgccatcaaggacagcaaggcagttcatgctgacatggggtactggatagaaagtgaaaagaacgaaacctggaagctggcgagagcctccttcatagaagtcaagacatgcacctggccaaaatctcacactctatggagcaatggagttttggaaagtgaaatgataatcccaaagatatatggaggaccaatatctcagcacaactacaggccagggtatttcacacaaacagcagggccatggcacctaggtaagttggaactggattttgacttgtgtgaaggcaccacagttgttgtggatgaacattgtggaaatcgaggtccatctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagattaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttactgtctttgacatttgtcaaaacaactctctcattggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactcctaaaaaatgatgtgccattggccggcccactaatagctggaggcatgctaatagcatgttatgtcatatccggaagctcagccgatttattattggagaaagcggctgaggtgtcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttgggcaggtcccaagtaggagtgggagtcttccaagacggcgtgttccacacaatgtggcacgtcaccaggggagctgtccttatgtaccaagggaagaggctggaaccaagctgggccagtgtcaaaaaggacttgatctcatatggaggaggttggagatttcaaggatcatggaacacgggagaagaagtgcaggtgatagctgttgaaccaggaaaaaaccccaaaaatgtacagacaacgccgggtaccttcaagactcctgaaggcgaagttggagccatagctctagatttcaaacccggcacatctggatctcccattgtgaacagagagggaaaaatagtgggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcaggaaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgttccaagcattaaatcaggaaatgacattgccaactgtttaagaaagaacggaaaacgggtaatccaactgagcagaaaaacctttgacactgagtaccagaaaacaaaaaacaatgactgggactatgttgtcacaacggacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagagaagaggaagaattggaaggaaccaaaacaaggagggtgatcagtatgtttacatgggacagcctttaaataatgatgaggatcacgctcattggacagaagcaaaaatgctccttgacaacataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggatgccagaacatactctgatccactggctctgcgcgagtttaaagagtttgcagcaggaagaagaagtgtctcaggtgacctaatattggaaatagggaaacttccacaacatttgacgctaagagcccagaatgctctggacaacttggtcatgttgcacaactccgaacaaggaggaaaagcctacagacacgctatggaggaactaccagacaccatagaaacattgatgcttctagctttgatagctgtgttgactggtggagtgacgctattcttcctatcaggaaaaggtttagggaaaacatctattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacacgctacaatgctggacgtagacctacgcccagcttcagcctggaccctctatgcagtagccacaacagttatcactcccatgatgagacacacaattgaaaatacaacggcaaacatttccctgacagccattgcaaatcaggcagctatattgatgggacttgacaagggatggccaatatcgaaaatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactctgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttttcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaaggaaaagtcatagacctcggttgtggaagaggtggctggtcatactattgtgctgggctgaagaaagttactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttctaaaaatggtggaaccatggctcaaaggaaaccaattctgcataaaaatcctaaatccttacatgccaagtgtggtagagactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatattattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcggcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccagggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgaccagagaggaagtggacaggtcggaacttatggcttaaatactttcaccaatatggaggtccaactaataagacaaatggagtctgaaggaatctttttacccagcgaattggaaactcccaacctagctgagagagttcttgactggttggaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggagccttcaaaaggatggaatgattggcagcaagtgcctttctgttcacaccatttccaccagctgatcatgaaggatgggagggaaatagtggtgccatgccgcaaccaagatgaacttgtgggcagggccagagtatcgcaaggcgccggatggagcctgagagaaactgcttgcctaggcaagtcatatgcacaaatgtggcagctgatgtacttccacaggagagacctgagactagcggctaacgctatctgttcagccgttccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcctgaaggagcactctggtaa

SEQ ID NO: 5611 - RNA, 9879 nt, synthetic construct
  misc_feature 1..9879: note = derived and/or modified CDS sequence (wt) from DENV-1__FJ639813__SS-prME
  source 1..9879: mol_type = other RNA
tccgtgaccatgctcctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggacttggcctagaaacaagaaccgaaacatggatgtcctctgaaggcgcctggaaacaaatacaaagagtggagacctgggctttgagacacccaggattcacggtgatagccctttttttagcacatgctataggaacatccatcactcagaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcatgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaacggctgcggactattcggaaagggaagtctattgacgtgtgccaagttcaagtgtgtgacaaaactagaaggaaagatagttcaatatgagaacttaaaatattcagtgatagttaccgtccacactggggaccagcatcaggtgggaaacgagaccacagaacatggaacaattgcaaccataacacctcaagctcctacgtcggaaatacagctgaccgactacggagcccttacattggactgctcacctagaacagggctggactttaatgagatggtgctattgacaatgaaagaaaaatcatggcttgtccacaaacaatggtttctagacttaccactgccatggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagactaaaaatggataaactgactttaaaggggatgtcatatgtgatgtgcacaggctcattcaagctagagaaggaagtggctgagacccagcatggaactgttctagtgcaggtcaaatacgaaggaacagacgcgccatgcaagatccccttctcgactcaagatgagaaaggagtgacccagaatgggagattgataacagccaatcccatagtaactgacaaagaaaaaccagtcaacattgagacagaaccaccttttggtgagagctacatcgtggtaggggcaggcgaaaaagctttgaaactaagctggttcaagaaaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgttcagcggtgtttcttggaccatgaaaataggaatagggattttgttgacatggttgggattaaattcaaggagcacgtcattttcgatgacgtgcattgcagttggcatggtcacactgtacctaggagtcatggttcaagcggactcgggatgtgtgatcaactggaagggcagagaacttaaatgtggaagtggcatttttgtcactaatgaagtccacacttggacagagcaatacaaattccaggctgactccccaaaaagactgtcagcagccattggaaaagcatgggaggagggagtgtgtggaattcgatcagccacgcgtcttgagaacatcatgtggaagcaaatatcaaatgaattgaaccacattctacttgaaaatgatatgaaattcacagtggttgtaggagatgctaacggaattttggcccaagggaaaaaaatgattaggccacaacccatggaacacaaatactcatggaaaagctggggaaaagctaaaatcataggagcagacatacaaaataccacctttatcatcgacggcccagacaccccagaatgtcccgatggccaaagagcatggaacatttgggaagttgaggactatgggtttggaattttcacgacaaacatatggctgaaattgcgtgactcctacacccaaatgtgtgaccaccggctaatgtcagctgccatcaaggacagcaaggcagttcatgctgacatggggtactggatagaaagtgaaaagaacgaaacctggaagctggcgagagcctccttcatagaagtcaagacatgcacctggccaaaatctcacactctatggagcaatggagttttggaaagtgaaatgataatcccaaagatatatggaggaccaatatctcagcacaactacaggccagggtatttcacacaaacagcagggccatggcacctaggtaagttggaactggattttgacttgtgtgaaggcaccacagttgttgtggatgaacattgtggaaatcgaggtccatctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagattaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttactgtctttgacatttgtcaaaacaactctctcattggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactcctaaaaaatgatgtgccattggccggcccactaatagctggaggcatgctaatagcatgttatgtcatatccggaagctcagccgatttatcattggagaaagcggctgaggtgtcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttgggcaggtcccaagtaggagtgggagtcttccaagacggcgtgttccacacaatgtggcatgtcaccaggggagctgtccttatgtaccaagggaagaggctggaaccaagctgggccagtgtcaaaaaggacttgatctcatatggaggaggttggagatttcaaggatcatggaacacgggagaagaagtgcaggtgatagctgttgaaccaggaaaaaaccctaaaaatgtacagacaacgccgggtaccttcaagactcctgaaggcgaagttggagccatagctctagatttcaaacccggcacatctggatctcccattgtgaacagagagggaaaaatagtgggtctttatggaaatggagtggtaacaacaagtggaacctacgtcagtgccattgcccaagctaaagcatcacaggaagggcctctaccagagattgaggacgaggtgtttaagaaaagaaacttaacaataatggacctgcacccaggatcaggaaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgttccaagcattaaatcaggaaatgacattgccaactgtttaagaaagaacggaaaacgggtaatccaactgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagagaagaggaagaattggaaggaaccaaaacaaggaaggtgatcagtatgtttacatgggacagcctttaaacaatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggatgccagaacatactctgatccactggctctgcgcgagtttaaagagtttgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacacgctatggaggaactaccagacaccatagaaacattgatgcttctagctttgatagctgtgttgactggtggagtgacgctattcttcctatcaggaaaaggtttagggaaaacatctattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacacgctacaatgctggacgtagacctacgcccagcttcagcctggaccctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttttcattaatgaaatctttaggaggaggtaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaaggaaaagtcatagacctcggttgtggaagaggtggctggtcatactattgtgctgggctgaagaaagttactgaagtgaagggatacacaaaaggaggacctggacatgaggaacccatgccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttctaaaaatggtggaaccatggctcaaaggaaaccaattctgcataaaaatcctaaacccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaaaccaacatatgaaagagacgtggacttaggcgctggaacaagacatgtggcagtggaaccagaggtagccaacctagatattattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaactcggcaataggagcagtgttcgttgatgaaaaccaatggaactcggcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccagggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgaccagagaggaagtggacaggtcggaacttatggcttaaatactttcaccaatatggaggtccaactaataagacaaatggagtctgaaggaatcttttcacccagcgaattggaaactcccaacctagctgagagagttcttgactggttggaaaaacatggcgccgaaaggctgaaacgaatggcaatcagcggagatgattgcgtggtgaaaccaattgacgacaggttcgcaacagccttaacagctctgaatgatatgggaaaagtaagaaaagacataccgcagtgggagccttcaaaaggatggaatgattggcagcaagtgcctttctgttcacaccatttccaccagctgatcatgaaggatgggagggaaatagtggtgccatgccgcaaccaagatgaacttgtgggcagggccagagtatcgcaaggcgccggatggagcctgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcctgaaggagcactctggtaa

SEQ ID NO: 5612 - RNA, 9879 nt, synthetic construct
  misc_feature 1..9879: note = derived and/or modified CDS sequence (wt) from DENV-1__JN819412__SS-prME
  source 1..9879: mol_type = other RNA
tccgtgaccatgctcctcatgctgttgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacctgggctttgagacacccaggattcacggtgatagccctttttttagcacatgctataggaacatccatcactcagaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaacggctgcggactattcggaaagggaagtctattgacgtgtgccaagttcaagtgtgtgacaaaactagaaggaaagatagttcaatatgagaacttaaaatattcagtgatagttaccgtccacactggggaccagcatcaggtgggaaacgagaccacagaacatggaacaattgcaaccataacacctcaagctcctacgtcggaaatacagctgaccgactacggagcccttacattggactgctcacctagaacagggctggactttaatgagatggtgctattgacaatgaaagaaaaatcatggcttgtccacaaacagtggtttctagacttaccactgccatggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagactaaaaatggataaactgactttaaaggggatgtcatatgtgatgtgcacaggctcattcaagttagagaaggaagtggctgagacccagcatggaactgttctagtgcaggtcaaatacgaaggaacagacgcgccatgcaagatccccttctcgactcaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagaaaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgttcagcggtgtttcttggaccatgaaaataggaatagggattctgttgacatggttgggattaaattcaaggagcacgtcactttcgatgacgtgcattgcagttggcatggtcacactgtacctaggagtcatggttcaagcggactcgggatgtgtgatcaactggaagggcagagaacttaaatgtggaagtggcatttttgtcactaatgaagtccacacttggacagagcaatacaaattccaggctgactccccaaaaagactgtcagcagccattggaaaggcatgggaggagggagtgtgtggaattcgatcagccacgcgtcttgagaacatcatgtggaagcaaatatcaaatgaattgaaccacattctacttgaaaatgatatgaaattcacagtggttgtaggagatgctaacggaattttggcccaagggaaaaaaatgattaggccacaacccatggaacacaaatactcatggaaaagctggggaaaagctaaaatcataggagcagacatacaaaataccacctttatcatcgacggcccagacaccccagaatgtcccgatggccaaagagcatggaacatttgggaagttgaggactatgggtttggaattttcacgacaaacatatggctgaaattgcgtgactcctacacccaaatgtgtgaccaccggctaatgtcagctgccatcaaggacagcaaggcagttcatgctgacatggggtactggatagaaagtgaaaagaacgaaacctggaagctggcgagagcctccttcatagaagtcaagacatgcacctggccaaaatctcacactctatggagcaatggagttttggaaagtgaaatgataatcccaaagatatatggaggaccaatatctcagcacaactacaggccagggtatttcacacaaacagcagggccatggcacctaggtaagttggaactggattttgacttgtgtgaaggcaccacagttgttgtggatgaacattgtggaaatcgaggtccatctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagattaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttactgtctttgacatttgtcaaaacaactctctcattggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactcctaaaaaatgatgtgccattggccggcccactaatagctggaggcatgctaatagcatgttatgtcatatccggaagctcagccgatttattattggagaaagcggctgaggtgtcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttgggcaggtcccaagtaggagtgggagtcttccaagacggcgtgttccacacaatgtggcacgtcaccaggggagctgtccttatgtaccaagggaagaggctggaaccaagctgggccagtgtcaaaaaggacttgatctcatatggaggaggttggagatttcaaggatcatggaacacgggagaagaagtgcaggtgatagctgttgaaccaggaaaaaaccccaaaaatgtacagacaacgccgggtaccttcaagactcctgaaggcgaagttggagccatagctctagatttcaaacccggcacatctggatctcccattgtgaacagagagggaaaaatagtgggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcaggaaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgttccaagcattaaatcaggaaatgacattgccaactgtttaagaaagaacggaaaacgggtaatccaactgagcagaaaaacctttgacactgagtaccagaaaacaaaaaacaatgactgggactatgttgtcacaacggacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagagaagaggaagaattggaaggaaccaaaacaaggaaggtgatcagtatgtttacatgggacagcctttaaataatgatgaggatcacgctcattggacagaagcaaaaatgctccttgacaacataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggatgccagaacatactctgatccactggctctgcgcgagtttaaagagtttgcagcaggaagaagaagtgtctcaggtgacctaatattggaaatagggaaacttccacaacatttgacgctaagagcccagaatgctctggacaacttggtcatgttgcacaactccgaacaaggaggaaaagcctacagacacgctatggaggaactaccagacaccatagaaacattgatgcttctagctttgatagctgtgttgactggtggagtgacgctattcttcctatcaggaaaaggtttagggaaaacatctattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacacgctacaatgctggacgtagacctacgcccagcttcagcctggaccctctatgcagtagccacaacagttatcactcccatgatgagacacacaattgaaaatacaacggcaaacatttccctgacagccattgcaaatcaggcagctatattgatgggacttgacaagggatggccaatatcgaaaatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactctgtacatcacagatccttttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttttcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaaggaaaagtcatagacctcggttgtggaagaggtggctggtcatactattgtgctgggctgaagaaagttactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttctaaaaatggtggaaccatggctcaaaggaaaccaattctgcataaaaatcctaaatccttacatgccaagtgtggtagagactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagatgtggacttaggcgctggaacaagacatgtggcagtggaaccagaggtagccaacctagatattattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcggcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccagggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgaccagagaggaagtggacaggtcggaacttatggcttaaatactttcaccaatatggaggtccaactaataagacaaatggagtctgaaggaatctttttacccagcgaattggaaactcccaacctagctgagagagttcttgactggttggaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggagccttcaaaaggatggaatgattggcagcaagtgcctttctgttcacaccatttccaccagctgatcatgaaggatgggagggaaatagtggtgccatgccgcaaccaagatgaacttgtgggcagggccagagtatcgcaaggcgccggatggagcctgagagaaactgcttgcctaggcaagtcatatgcacaaatgtggcagctgatgtacttccacaggagagacctgagactagcggctaacgctatctgttcagccgttccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcctgaaggagcactctggtaa

SEQ ID NO: 5613 - RNA, 9879 nt, synthetic construct
  misc_feature 1..9879: note = derived and/or modified CDS sequence (wt) from DENV-1__FJ810415__SS-prME
  source 1..9879: mol_type = other RNA
tccgtgaccatgctcctcatgctgctgcccacagccctggcgtttcatttgaccacacgagggggagagccacacatgatagttagtaagcaggaaagaggaaagtcactcttgtttaagacctctgcgggcgtcaatatgtgcaccctcattgcgatggacttgggagagttatgtgaggacacaatgacttacaaatgcccccggatcactgaggcggaaccagatgacgttgactgctggtgcaatgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggaaacaaatacaaagagtggaaacttgggctttgagacacccaggattcacggtgatagccttttttttagcacatgctataggaacatccatcactcaaaaaggggtcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgcggactattcggaaagggaagtctattgacgtgtgccaagttcaagtgtgtgacaaaactagaaggaaagatagttcaatatgaaaacttaaaatattcagtgatagtcactgtccacactggggaccagcaccaggtgggaaacgagaccacagaacatggaacaattgcaaccataacacctcaagctcccacgtcggaaatacagctgaccgactacggagccctcacattggactgctcacctagaacagggctggactttaatgagatggtgctattgacaatgaaagaaaaatcatggcttgtccacaaacaatggtttctagacttaccactgccatggacttcgggggcttcaacatctcaagagacctggaacagacaagatttgctggtcacattcaagacagctcatgcaaagaaacaggaagtagtcgtactgggatcacaggaaggagcaatgcacacagcgttgactggggcgacagaaatccagacgtcaggaacgacaacaatcttcgcaggacacctgaaatgcagactaaaaatggataaactgaccttaaaggggatgtcatatgtgatgtgcacaggctcatttaagctagagaaggaagtggctgagacccagcatggaactgttctagtgcaggtcaaatatgaaggaacagacgcgccatgcaagatccccttttcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaaactggttcaagagaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgtttagcggtgtttcttggaccatgaaaataggaatagggattctgctgacatggttgggattaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtgtgtggaattcgatcagccacgcgtcttgagaacatcatgtggaagcaaatatcaaatgaattgaaccacattctacttgagaatgacatgaaattcacagtggttgtaggagatgccaacggaattttggcccaaggaaaaaaaatgattaggccacaacccatggaacacaaatactcatggaaaagctggggaaaagctaaaatcataggagcagacatacaaaatactaccttcatcatcgacggcccagacaccccagaatgtcccgatggccaaagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacagcagggccatggcacctaggtaagttggaactggattttgacttgtgtgaaggtaccacagttgttgtggatgaacattgtggaaatcgaggtccatctctcagaaccacaacagtcacaggaaagataatccatgaatggtgttgcagatcctgcacgctaccccccttacgtttcagaggagaagacgggtgttggtatggcatggaaatcagaccagtaaaggagaaggaggagaatctagtcaggtcaatggtctctgcagggtcaggagaagtggatagtttttcattaggaatactatgcgtgtcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttattgtctctgacatttgtcaaaacaactctctcactggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagctcactcctcaaaaatgatgtgccgttggccgggccactaatagctggaggcatgctaatagcatgttatgtcatatccggaagctcagccgatttatcattggagaaagcggctgaagtatcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttggggaggtcccaagtaggagtgggagtcttccaagacggcgtgttccacacaatgtggcacgttaccaggggagctgtccttatgtaccaagggaagagactggaaccaagctgggccagtgtcaaaaaggacttgatctcatatggaggaggttggaggttccaaggatcatggaacacaggagaagaagtgcaggtgatagctgttgaaccaggaaaaaaccccaaaaatgtacagacaacgccgggcaccttcaagactcctgaaggcgaagttggagccatagctctagatttcaaacccggcacatctggatctcccattgtgaacagagagggaaaaatagtgggtctgtatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcagggaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctttttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggacgccagaacatactctgatccattggccctgcgcgagtttaaagagttcgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggttatgtagccgccgaaaaccaccaacatgctacaatgctggacgtagacctacacccagcttcagcctggaccctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaacatcttcaggggaagttatctagcaggagcaggtctggctttctcattaatgaaatctttaggaggaggtaggagaggcacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaagctacactctggaaaggatgtattttttatgccacctgagaaatgtgacacccttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgacaccacaccctttggacaacagagagtgtttaaagagaaagttgacacgcgcacaccaagagcaaaacgaggcacaacacagattatggaggtgacagccaaatggttatggggtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgatcagagaggaagtggacaggtcggaacttatggcttaaatactttcaccaatatggaggtccaactaataagacaaatggagtctgaaggaatctttttacccagcgaattggaaacccccaacctagctgagagggctcttgactggttagaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcaaaaggatggaatgattggcagcaagtgcctttttgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctaggaaaaagggaagaccaatggtgtggatccctgataggcttgacagcgagggccacctgggccaccaacatacaagtagccataaaccaagtgagaaggctcatcgggaatgagaattatttagattacatgacatcaatgaagagattcaagaatgagagtgatcccgaaggagcactctggtaa

SEQ ID NO: 5614 - RNA, 9879 nt, synthetic construct
  misc_feature 1..9879: note = derived and/or modified CDS sequence (wt) from DENV-1__FJ639814__SS-prME
  source 1..9879: mol_type = other RNA
tccgtgaccatgctcctcatgctgctgcccacagccctggcgtttcatttgaccacacgagggggagagccacacatgatagttagtaagcaggaaagaggaaagtcactcttgtttaagacctctgcgggcgtcaatatgtgcaccctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggaaacaaatacaaagagtggaaacttgggctttgagacacccaggattcacggtgatagccttttttttagcacatgctataggaacatccatcactcaaaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgcggactattcggaaagggaagtctattgacgtgtgccaagttcaagtgtgtgacaaaactagaaggaaagatagttcaatatgaaaacttaaaatattcagtgatagtcactgtccacactggggaccagcaccaggtgggaaacgagaccacagaacatggaacaattgcaaccataacacctcaagctcccacgtcggaaatacagctgaccgactacggagccctcacattggactgctcacctagaacagggctggactttaatgagatggtgctattgacaatgaaagaaaaatcatggcttgtccacaaacaatggtttctagacttaccactgccatggacttcgggggcttcaacatctcaagagacctggaacagacaagatttgctggtcacattcaagacagctcatgcaaagaaacaggaagtagtcgtactgggatcacaggaaggagcaatgcacacagcgttgactggggcgacagaaatccagacgtcaggaacgacaacaatcttcgcaggacacctgaaatgcagactaaaaatggataaactgaccttaaaggggatgtcatatgtgatgtgcacaggctcatttaagctagagaaggaagtggctgagacccagcatggaactgttctagtgcaggtcaaatatgaaggaacagacgcgccatgcaagatccccttttcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgtttagcggtgtttcttggaccatgaaaataggaatagggattctgctgacatggttgggattaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtgtgtggaattcgatcagccacgcgtcttgagaacatcatgtggaagcaaatatcaaatgaattgaaccacattctacttgagaatgacatgaaattcacagtggttgtaggagatgccaacggaattttggcccaagggaaaaaaatgattaggccacaacccatggaacacaaatactcatggaaaagctggggaaaagctaaaatcataggagcagacatacaaaatactaccttcatcatcgacggcccagacaccccagaatgtcccgatggccaaagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacagcagggccatggcacctaggtaagttggaactggattttaacttgtgtgaaggtaccacagttgttgtggatgaacattgtggaaatcgaggtccatctctcagaaccacaacagtcacaggaaagataatccatgaatggtgttgcagatcctgcacgctaccccccttacgtttcagaggagaagacgggtgttggtatggcatggaaatcagaccagtaaaggagaaggaggagaatctagtcaggtcaatggtctctgcagggtcaggagaagtggatagtttttcattaggaatactatgcgtgtcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttattgtctctgacatttgtcaaaacaactctctcactggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagctcactcctcaaaaatgatgtgccgttggccgggccactaatagctggaggcatgctaatagcatgttatgtcatatccggaagctcagccgatttatcattggagaaagcggctgaagtatcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttggggaggtcccaagtaggagtgggagtcttccaagacggcgtgttccacacaatgtggcacgttaccaggggagctgtccttatgtaccaagggaagagactggaaccaagctgggccagtgtcaaaaaggacttgatctcatatggaggaggttggaggttccaaggatcatggaacacaggagaagaagtgcaggtgatagctgttgaaccaggaaaaaaccccaaaaatgtacagacaacgccgggcaccttcaagactcctgaaggcgaagttggagccatagctctagatttcaaacccggcacatctggatctcccattgtgaacagagagggaaaaatagtgggtctgtatggaaatggagtggtaacaacaagtggaacctacgtcagtgccattgcccaagctaaagcatcacaggaagggcctctaccagagattgaggacgaggtgtttaagaaaagaaacttaacaataatggacctgcacccaggatcagggaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctttttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggacgccagaacatactctgatccattggccctgcgcgagtttaaagagttcgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgctacaatgctggacgtagacctacacccagcttcagcctggaccctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaagctacactctggaaaggatgtattttttatgccacctgagaaatgtgacacccttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatctagaatgttactgaaccgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacagattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatacttagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgatcagagaggaagtggacaggtcggaacttatggcttaaatactttcaccaatatggaggtccaactaataagacaaatggagtctgaaggaatctttttacccagcgaattggaaacccccaacctagctgagagggctcttgactggttagaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcaaaaggatggaatgattggcagcaagtgcctttttgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctaggaaaaagggaagaccaatggtgtggatccctgataggcttgacagcgagggccacctgggccaccaacatacaagtagccataaaccaagtgagaaggctcatcgggaatgagaattatttagattacatgacatcaatgaagagattcaagaatgagagtgatcccgaaggagcactctggtaa

SEQ ID NO: 5615 - RNA, 9879 nt, synthetic construct
  misc_feature 1..9879: note = derived and/or modified CDS sequence (wt) from DENV-1__FJ639815__SS-prME
  source 1..9879: mol_type = other RNA
tccgtgaccatgctcctcatgctgctgcccacagccctggcgtttcatttgaccacacgagggggagagccacacatgatagttagtaagcaggaaagaggaaagtcactcttgtttaagacctctgcgggcgtcaatatgtgcaccctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggaaacaaatacaaagagtggaaacttgggctttgagacacccaggattcacggtgatagccttttttttagcacatgctataggaacatccatcactcaaaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgcggactattcggaaagggaagtctattgacgtgtgccaagttcaagtgtgtgacaaaactagaaggaaagatagttcaatatgaaaacttaaaatattcagtgatagtcactgtccacactggggaccagcaccaggtgggaaacgagaccacagaacatggaacaattgcaaccataacacctcaagctcccacgtcggaaatacagctgaccgactacggagccctcacattggactgctcacctagaacagggctggactttaatgagatggtgctattgacaatgaaagaaaaatcatggcttgtccacaagcaatggtttctagacttaccactgccatggacttcgggggcttcaacatctcaagagacctggaacagacaagatttgctggtcacattcaagacagctcatgcaaagaaacaggaagtagtcgtactgggatcacaggaaggagcaatgcacacagcgttgactggggcgacagaaatccagacgtcaggaacgacaacaatcttcgcaggacacctgaaatgcagactaaaaatggataaactgaccttaaaggggatgtcatatgtgatgtgcacaggctcatttaagctagagaaggaagtggctgagacccagcatggaactgttctagtgcaggtcaaatatgaaggaacagacgcgccatgcaagatccccttttcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgtttagcggtgtttcttggaccatgaaaataggaatagggattctgctgacatggttgggattaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtgtgtggaattcgatcagccacgcgtcttgagaacatcatgtggaagcaaatatcaaatgaattgaaccacattctacttgagaatgacatgaaattcacagtggttgtaggagatgccaacggaattttggcccaagggaaaaaaatgattaggccacaacccatggaacacaaatactcatggaaaagctggggaaaagctaaaatcataggagcagacatacaaaacactaccttcatcatcgacggcccagacaccccagaatgtcccgatggccaaagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacagcagggccatggcacctaggtaagttggaactggattttgacttgtgtgaaggtaccacagttgttgtggatgaacattgtggaaatcgaggtccatctctcagaaccacaacagtcacaggaaagataatccatgaatggtgttgcagatcctgcacgctaccccccttacgtttcagaggagaagacgggtgttggtatggcatggaaatcagaccagtaaaggagaaggaggagaatctagtcaggtcaatggtctctgcagggtcaggagaagtggatagtttttcattaggaatactatgcgtgtcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttattgtctctgacatttgtcaaaacaactctctcactggattatgcatggaaaacaacggctatgctactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagctcactcctcaaaaatgatgtgccgttggccgggccactaatagctggaggcatgctaatagcatgttatgtcatatcaggaagctcagccgatttatcattggagaaagcggctgaagtatcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttggggaggtcccaagtaggagtgggagtcttccaagacggcgtgttccacacaatgtggcacgttaccaggggagctgtccttatgtaccaagggaagagactggaaccaagctgggccagtgtcaaaaaggacttgatctcatatggaggaggttggaggttccaaggatcatggaacacaggagaagaagtgcaggtgatagctgttgaaccaggaaaaaaccccaaaaatgtacagacaacgccgggcaccttcaagactcctgaaggcgaagttggagccatagctctagatttcaaacccggcacatctggatctcccattgtgaacagagagggaaaaatagtgggtctgtatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcagggaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctttttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggacgccagaacatactctgatccattggccctgcgcgagtttaaagagttcgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccagcatgctacaatgctggacgtagacctacacccagcttcagcctggaccctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaagctacactctggaaaggatgtattttttatgccacctgagaaatgtgacacccttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatctagaatgttactgaaccgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacagattatggaggtgacagccaagtggttatggggtttcctttccagaaacaaaaagcccagaatctgcacaagagaggagttcacaagaaaggttaggtcaaacgcggcaataggagcagttttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatacttagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgatcagagaggaagtggacaggtcggaacttatggcttaaatactttcaccaatatggaggtccaactaataagacaaatggagtctgaaggaatctttttacccagcgaattggaaacccccaacctagctgagagggctcttgactggttagaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcaaaaggatggaatgattggcagcaagtgcctttttgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctaggaaaaagggaagaccaatggtgtggatccctgataggcttgacagcgagggccacctgggccaccaacatacaagtagccataaaccaagtgagaaggctcatcgggaatgagaattatttagattacatgacatcaatgaagagattcaagaatgagagtgatcccgaaggagcactctggtaa

SEQ ID NO: 5616 - RNA, 9879 nt, synthetic construct
  misc_feature 1..9879: note = derived and/or modified CDS sequence (wt) from DENV-1__FJ639818__SS-prME
  source 1..9879: mol_type = other RNA
tccgtgaccatgctcctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccggatcactgaggcggaaccagatgacgttgactgctggtgcaacaccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacctgggctttgagacacccaggattcacggtgatagccctttttttagcacatgctataggaacatccatcactcagaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaatcctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaacggctgcggactattcggaaagggaagtctattgacgtgtgccaagttcaagtgtgtgacaaaactagaaggaaagatagttcaatatgagaacttgaaatattcagtgatagttaccgtccacactggggaccagcatcaggtggggaacgagaccacagaacatggaacaattgcaaccataacacctcaagctcctacgtcggaaatacagctgaccgactacggagcccttacattggactgctcacctagaacagggctggactttaatgagatggtgctattgacaatgaaagaaaaatcatggcttgtccacaaacaatggtttctagacttaccactgccatggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagactaaaaatggaaaaactgactttaaaggggatgtcatatgtgatgtgcacaggctcattcaagctagagaaggaagtggctgagacccagcatggaactgttctagtgcaggtcaaatacgaaggaacagacgcgccatgcaagatccccttctcgactcaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagaaaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgttcagcggtgtttcttggaccatgaaaataggaatagggattctgttgacatggttgggattaaattcaaggagcacgtcactttcgatgacgtgcattgcagttggcatggtcacactgtacctaggagtcatggttcaagcggactcgggatgtgtgatcaactggaagggcagagaacttaaatgtggaagtggcatttttgtcactaatgaagtccacacttggacagagcaatacaaattccaggctgactccccaaaaagactgtcagcagccattggaaaggcatgggaggaaggagtgtgtggaattcgatcagccacgcgtcttgagaacatcatgtggaagcaaatatcaaatgaattgaaccacattctacttgaaaatgatatgaaattcacagtggttgtaggagatgctaacggaattttggcccaagggaaaaaaatgattaggccacaacccatggaacacaaatactcatggaaaagctggggaaaagctaaaatcataggagcagacatacaaaataccacctttatcatcgacggcccagacaccccagaatgtcccgatggccaaagagcatggaacatttgggaagttgaggactatgggtttggaattttcacgacaaacatatggcttaaattgcgtgactcctacacccaaatgtgtgaccaccggctaatgtcagctgccatcaaggacagcaaggcagttcatgctgacatggggtactggatagaaagtgaaaagaacgaaacctggaagctggcgagagcctccttcatagaagtcaagacatgcacctggccaaaatctcacactctatggagcaatggagttttggaaagtgaaatgataatcccaaagatatatggaggaccaatatctcagcacaactacaggccagggtatttcacacaaacagcagggccatggcacctaggtaagttggaactggattttgacttgtgtgaaggcaccacagttgttgtggatgaacattgtggaaatcgaggtccatctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacacacctagccttgatggctactttcaaaatgagaccaatgttcgctgttgggctattattccgcagattaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttactgtctttgacatttgtcaaaacaactctctcattggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcatcctactaagttcactcctaaaaaatgatgtgccattggccggcccactaatagctggaggcatgctaatagcatgttatgtcatatccggaagctcagccgatttatcactggagaaagcggctgaggtgtcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttgggcaggtcccaagtaggagtgggagtcttccaagacggcgtgttccacacaatgtggcacgtcaccaggggagctgtccttatgtaccaagggaagaggctggaaccaagctgggccagtgtcaaaaaggacttgatctcatatggaggaggttggagatttcaaggatcatggaacacgggagaagaagtgcaggtgatagctgttgaaccaggaaaaaaccccaaaaatgtacagacaacgccgggtaccttcaagactcctgaaggcgaagttggagccatagctctagatttcaaacccggcacatctggatctcccattgtgaacagagagggaaaaatagtgggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcaggaaaaacaagaagatatcttccagccatagtccgtgaggccataaaaaggaaactgcgcacgttaatcttggctcccacaagagttgttgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcctccaggatcggtggaggcctttccacagagcaatgcagttatccaagatgaggaaagagacattcctgagagatcatggaactcaggctacgactggatcactgactttccaggtaaaacagtctggtttgttccaagcattaaatcaggaaatgacattgccaactgtttaagaaagaacggaaaacgggtaatccaactgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagagaagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggatgccagaacatactctgatccactggctctgcgcgagtttaaagagtttgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacacgctatggaggaactaccagacaccatagaaacattgatgcttctagctttgatagctgtgttgactggtggagtgacgctattcttcctatcaggaaaaggtttagggaaaacatctattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacacgctacaatgctggacgtagacctacgcccagcttcagcctggaccctctatgcagtagccacaacagttatcactcccatgatgagacatacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttagatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttttcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaaggaaaagtcatagacctcggttgtggaagaggtggctggtcatactattgtgctgggctgaagaaagttactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttctaaaaatggtggaaccatggctcaaaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatattattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcggcaataggagcggtgtttgttgatgaaaaccaatggaactcggcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccagggggaaatatgtatgcagatgatacagccggatgggacacaagaataacagaggatgatcttcagaatgaggctaaaatcactgacatcatggagcctgaacatgctctattggccacgtcaatttttaagctgacttatcaaaacaaggtggtgagggtgcaaagaccagcaaaaaatggaaccgtgatggatgttatatccagacgtgaccagagaggaagtggacaggtcggaacttatggcttaaatactttcaccaatatggaggtccaactaataagacaaatggagtctgaaggaatctttttacccagcgaattggaaactcccaacctagctgagagagttcttgactggttggaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggagccttcaaaaggatggaatgattggcagcaagtgcctttctgttcacaccatttccaccagctgatcatgaaggatgggagggaaatagtggtgccatgccgcaaccaagatgaacttgtgggcagggccagagtatcgcaaggcgccggatggagcctgagagaaactgcttgcctaggcaagtcatatgcacaaatgtggcagctgatgtacttccacaggagagacctgagactagcggctaacgccatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggtttgacagcgagggccacctgggccaccaacatacaagtagccataaaccaagtgagaaggctcatcgggaatgagaattatctagattacatgacatcaatgaagagattcaagaatgagagtgatcctgaaggagcactctggtaa

SEQ ID NO: 5617 - RNA, 9879 nt, synthetic construct
  misc_feature 1..9879: note = derived and/or modified CDS sequence (wt) from DENV-1__FJ639819__SS-prME
  source 1..9879: mol_type = other RNA
tccgtgaccatgctcctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagagaaacgttccgtggcactggccccacatgtgggacttggtctagaaacaagaaccgaaacatggatgtcctctgaaggcgcctggaaacaaatacaaagagtggagacttgggctttgagacacccaggattcacggtgatagccttttttttagcacatgctataggaacatccatcactcagaaagggatcatcttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggcaatggctgcggactattcggaaagggaagtctattgacgtgtgccaagttcaagtgtgtgacaaaactagaaggaaagatagttcaatatgaaaacttaaaatactcagtgatagtcactgtccacactggggaccagcaccaggtgggaaacgagaccacagaacatggaacaattgcaaccataacaccacaagctccgacgtcggaaatacagctgaccgactacggagccctcacattggactgctcacctagaacagggctggactttaatgagatggtgctattgacaatgaaagaaaaatcatggcttgtccacaaacaatggtttctagacttaccactgccatggacttcgggggcttcaacatctcaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagactaaaaatggataaactgaccttaaaggggatgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatctgtgggaaagttggtacaccaggtttttggaaccgcatatggggttctgttcagcggtgtttcttggaccatgaaaataggaatagggattctgctgacatggttgggattaaattcaaggagcacgtcactttcgatgacgtgcattgcagttggcatggtcacactgtacctaggagtcatggttcaagcagactcgggatgtgtaatcaactggaagggcagagaacttaaatgtggaagtggcatttttgtcactaatgaagttcacacttggacagagcaatacaaattccaggctgactccccaaaaagactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaacggaattttggcccaaggaaaaaaaatgattaggccacaacccatggaacacaaatactcatggaaaagctggggaaaagctaaaatcataggagcagacatacaaaataccaccttcatcatcgacggcccagacaccccagaatgtcccgatggccaaagagcatggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacagcagggccatggcacctaggtaagttggaactggattttgacttgtgtgaaggtaccacagttgttgtggatgaacattgtggaaatcgaggtccatctctcagaactacaacagtcacaggaaagataatccatgaatggtgttgcagatcctgcacgctaccccccttacgtttcagaggagaagacggatgttggtatggcatggaaatcagaccagtaaaggagaaggaggagaatctagttaggtcaatggtctctgcagggtcaggagaagtggacaatttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttactgtctctgacatttgtcaaaacaactctctcattggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactcctcaaaaatgatgtgccgttggccggcccactaatagctggaggcatgctaatagcatgttatgtcatatccggaagctcagctgatttatcattggagaaagcggctgaagtatcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttgggcaggtcccaagtaggagtgggagtcttccaagacggcgtgttccacacaatgtggcacgtcaccaggggagctgtccttatgtaccaagggaagaggctggaaccaagctgggcctgtgtcaaaaaggacttgatctcatatggaggaggttggaggtttcaaggattatggaacacgggagaagaagtgcaggtgatagctgttgaaccaggaaaaaaccccaaaaatgtacagacaacgccgggtaccttcaagactcctgaaggcgaagttggagccatagctctagatttcaaacccggcacatctggatctcccattgtgaacagagagggaaaaatagtgggtctttatggaaatggagtggtgacaacaagcggaacctacgtcagtgccattgcccaagctaaagcatcacaggaagggcctctaccagagatcgaggacgaggtgtttaagaaaagaaacttaacaataatggacctgcacccaggatcagggaaaacaagaagatatcttccagccatagtccgtgaggccataaaaaggaaactgcgtacgttaatcctggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgattttccaggcaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttatatgggacagcctttaaataatgatgaggatcacgctcattggacagaagcaaaaatgctccttgacaatataaacacaccagaagggatcatcccagccctttttgagccagagagagaaaagagtgcagcaatagatggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggatgccagaacatactctgatccactggccctgcgcgagtttaaagagtttgcagcaggaagaagaagtgtctcaggtgacctgatattggaaatagggaaacttccacaacatttgacgctaagagcccagaatgccctggacaacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtttagggaaaacatccattggcttgctctgtgtgacggcctcaagtgcactgttatggatggccagtgtggagccccattggatagcggcctccatcatactagagttctttttgatggtgctgctcattccagagccagacagacagcgcactccacaggacaaccagctagcatatgtggtgataggcttgttattcatgatacttacagtggcagccaatgagatgggattattggaaaccacaaagaaagacctggggattggctatgtagccgccgaaaaccaccaacatgctacaatgctggacgtagacctacacccagcttcagcctggaccctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacgctgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccagataatgttactgatactttgtacatcacagatcctcttgatgcggaccacatgggccttgtgtgaatccatcacactggctactggacccctgactactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaaggaaaagtcatagacctcggttgtggaagaggtggctggtcatattattgtgctgggctgaagaaagttactgaagtgaagggatacacaaaaggaggacctggacatgaggagcctatcccaatggcgacctatggatggaacctagtaaagctacactctggaaaagatgtatttttcatgccacctgagaaatgtgacacccttctgtgtgatattggtgagtcctctccaaatccaaccatagaagaaggaagaacgttacgtgttctaaaaatggtggaaccatggctcagaggaaaccaattctgcataaaaatcttaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgctactgaaccgattcacaatggctcacaggaagccaacatatgaaagagatgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcggcaataggagcagtgttcgttgacgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaactcggatacatactcagagacatatcaaagattccggggggaaacatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgaccagagaggaagtggacaggtcggaacttatggcttaaatactttcaccaatatggaggtccaactaataagacaaatggagtctgaagggatctttttacccagcgaattggaaacccccaacctagctgagagagttcttgactggttagaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagatctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcccgaaggagcactctggtaa

SEQ ID NO: 5618 - RNA, 9879 nt, synthetic construct
  misc_feature 1..9879: note = derived and/or modified CDS sequence (wt) from DENV-1__FJ639820__SS-prME
  source 1..9879: mol_type = other RNA
tccgtgaccatgctcctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacctgggctttgagacacccaggattcacggtgatagccctttttttagcacatgctataggaacatccatcactcagaaagggatcattttcatcttgctgatgctggtgacaccatcaatggccatgcgatgcgtgggaataggcaacagagactttgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaacggctgcggactattcggaaagggaagtctattgacgtgtgccaagttcaagtgtgtgacaaaactagaaggaaagatagttcaatatgagaacttaaaatattcagtgatagttaccgtccacactggggaccagcatcaggtgggaaacgagaccacagagcatggaacaattgcaaccataacacctcaagctcctacgtcggaaatacagctgaccgactacggagcccttacattggactgctcacctagaacagggctggactttaatgagatggtgctattgacaatgaaagaaaaatcatggcttgtccacaaacaatggtttctagacttaccactgccatggacttcgggggcttcaacatcccaagagacctggaacagacaagatttgctggttacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagactaaaaatggataaactgactttaaaggggatgtcatatgtgatgtgcacaggctcattcaagctagagaaggaagtggctgagacccagcatggaactgttctagtgcaggtcaaatacgaaggaacagacgcgccatgcaagatcccattctcgactcaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagaaaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgttcagtggtgtttcttggaccatgaaaataggaatagggattctgttgacatggttgggattaaattcaaggagcacgtcactttcgatgacgtgcattgcagttggcatggtcacactgtacctaggagtcatggttcaagcggactcgggatgtgtgatcaactggaagggcagagaacttaaatgtggaagtggcatttttgtcactaatgaagtccacacttggacagagcaatacaaattccaggctgactccccaaaaagactgtcagcagccattggaaaggcatgggaggagggagtgtgtggaattcgatcagccacgcgtcttgagaacatcatgtggaagcaaatatcaaatgaattgaaccacattctacttgaaaatgatatgaaattcacagtggttgtaggagatgctaacggaattttggcccaagggaaaaaaatgattaggccacaacccatggaacacaaatactcatggaaaagctggggaaaagctaaaatcataggagcagacatacaaaataccacctttatcatcgacggcccagacaccccagaatgtcccgatggccaaagagcatggaacatttgggaagttgaggactatgggtttggaattttcacgacaaacatatggctgaaattgcgtgactcctacacccaaatgtgtgaccacaggctaatgtcagctgccatcaaggacagcaaggcagttcatgctgacatggggtactggatagaaagtgaaaagaacgaaacctggaagctggcgagagcctccttcatagaagtcaagacatgcacctggccaaaatctcacactctatggagcaatggagttttggaaagtgaaatgataattccaaagatatatggaggaccaatatctcagcacaactacaggccagggtatttcacacaaacagcagggccatggcatctaggtaagttggaactggattttgacttgtgtgaaggcaccacagttgttgtggatgaacattgtggaaatcgaggtccatctctcagaactacaacagtcacaggaaagataatccatgaatggtgttgcagatcctgcacgttaccccccttacgttttagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagattaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttactgtctttgacatttgtcaaaacaactctctcattggattatgcatggaaaacaacggctatggtactgtctatcgtatctctctttcctttatgcctgtctacgacctcccaaaaaacaacatggcttccggtgctgttaggatcttttggatgcaagccattaaccatgtttcttataacagaaaacaaaatctggggaaggaaaagttggcccctcaatgaaggaattatggctattggaatagtcagcattctactaagttcactcctaaaaaatgatgtgccattggccggcccactaatagctggaggcatgctaatagcatgttatgtcatatccggaagctcagccgatttatcattggagaaagcggctgaggtgtcctgggaacaggaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttgggcaggtcccaagtaggagtgggagtcttccaagacggcgtgttccacacaatgtggcatgtcaccaggggagctgtccttatgtaccaagggaagaggctggaaccaagctgggccagtgtcaaaaaggacttgatctcatatggaggaggttggagatttcaaggatcatggaacacgggagaagaagtgcaggtgatagctgttgaaccaggaaaaaaccccaaaaatgtacagacaacgccgggtaccttcaagactcctgaaggcgaagttggagccatagctctagatttcaaacccggcacatctggatctcccattgtgaacagagagggaaaaatagtgggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcaggaaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgttccaagcattaaatcaggaaatgacattgccaactgtttaagaaagaacggaaaacgggtaatccaactgagcaggaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagagaagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggatgccagaacatactctgatccactggctctgcgcgagtttaaagagtttgcagcaggaagaagaagtgtctcaggtgacctaatattggaaatagggaaacttccacaacatttgacgctaagagcccagaatgctctggacaacttggccatgttgcacaattccgaacaaggaggaaaagcctacagacacgctatggaggaactaccagacaccatagaaacattgatgcttctagctttgatagctgtgttgactggtggagtgacgctattcttcctatcaggaaaaggtttagggaaaacatctattggcttgctctgtgtgacggcctcaagcgcactgttatggatggccagtgtggagccccactggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacacgctacaatgctggacgtagacctacgcccagcttcagcctggaccctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttttcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaaggaaaagtcatagacctcggttgtggaagaggtggctggtcatactattgtgctgggctgaagaaagttactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttctaaaaatggtggaaccatggctcaaaggaaaccaattctgcataaaaatcctaaatccttacatgccaagtgtggtggaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatattattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcggcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccagggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgaccagagaggaagtggacaggtcggaacttatggcttaaatactttcaccaatatggaggtccaactaataagacaaatggagtctgaaggaatctttttacccagcgaattggaaactcccaacctagctgagagagttcttgactggttggaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggagccttcaaaaggatggaatgattggcagcaagtgcctttctgttcacaccatttccaccagctgatcatgaaggatgggagggaaatagtggtgccatgccgcaaccaagatgaacttgtgggcagggccagagtatcgcaaggcgccggatggagccttagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctaggaaaaagggaagatcaatggtgtggatccctgataggcttgacagcgagggccacctgggccaccaacatacaagtagccataaaccaagtgagaaggctcatcgggaatgagaattatctagattatatgacatcaatgaagagattcaagaatgagagtgatcctgaaggagcactctggtaa

SEQ ID NO: 5619 - RNA, 9879 nt, synthetic construct
  misc_feature 1..9879: note = derived and/or modified CDS sequence (wt) from DENV-1__FJ639821__SS-prME
  source 1..9879: mol_type = other RNA
tccgcgaccatgctcctcatgctgctgcccacagccctggcgttccatttgaccacacgagggggagagccacacatgatagttagtaagcaggaaagaggaaagtcactcttgtttaagacttctgcaggtgtcaatatgtgcactctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccttttttttagcacatgctataggaacatccatcactcagaaagggatcattttcatcttgctgatgctggtgacaccatcaatggccatgcgatgcgtgggaataggtaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgcggactattcggaaagggaagtctattgacgtgtgccaagttcaagtgtgtgacaaaactagaaggaaagatagttcaatatgaaaacttaaaatactcagtgatagtcactgtccacactggggaccagcaccaggtgggaaacgagaccacagaacatggaacaattgcaaccataacaccacaagctcctacgtcggaaatacagctgaccgactacggagccctcacattggactgctcacctagaacagggctggactttaatgagatggtgctattgacaatgaaagaaaaatcatggcttgtccacaaacaatggtttctagatttaccactgccatggacttcgggggcttcaacatctcaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagactaaaaatggataaactgaccttaaaggggatgtcatatgtgatgtgcacaggctcatttaagctagagaaggaagtggctgagacccagcatggaactgttctagtgcaggtcagatacgaaggaacagacgcgccatgcaagatccccttttcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatctgtgggaaagttggtacaccaggtttttggaaccgcatatggggttctgttcagcggtgtttcttggaccatgaaaataggaatagggattctgctgacatggttgggattaaattcaaggagcacgtcactttcgatgacgtgcattgcagttggcatggtcacactgtacctaggagtcatggttcaagcagactcgggatgtgtaatcaactggaagggcagagaacttaaatgtggaagtggcatttttgtcactaacgaagttcacacttggacagagcaatacaaattccaggctgactccccaaaaagactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaacggaattttggcccaagggaaaaaaatgattaggccacaacccatggaacacaaatactcatggaaaagctggggaaaagctaaaatcataggagcagacatacaaaataccaccttcatcatcgacggcccagacaccccagaatgtcccgatggccaaagagcatggaacatttgggaagttgaggactatgggtttggaattttcacgacaaacatatggctgaaattgcgtgactcctacacccaaatgtgtgatcaccggctaatgtcagctgccatcaaggacagcaaggcagtccatgctgacatggggtactggatagaaagtgaaaagaacgaaacctggaagctggcgagagcctccttcatagaagtcaagacatgcacttggccgaaatctcacactctatggagcaatggagttttggaaagtgaaatgataatcccaaagatatatggaggaccaatatctcagcacaactacagaccagggtattacacacaaacagcagggccatggcacctaggtaagttggaactggattttgacttgtgtgaaggtaccacagttgttgtggatgaacattgtggaaatcgaggtccatctctcagaaccacaacagtcacaggaaagataatccatgaatggtgttgcagatcctgcacgctaccccccttacgtttcagaggagaagacggatgttggtatggcatggaaatcagaccagtaaaggagaaggaggagaatctagttaggtcaatggtctctgcagggtcaggagaagtggacaatttttcattaggaatactatgtgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacgggatggggatgggaacaacgtacctagccttgatggctactttcaaaatgagaccaatgttcgctgttgggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttactgtctctgacatttgtcaaaacaactctctcattggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggccattggaatagtcagcattctactaagttcactcctcaaaaatgatgtgccgttggccggcccactaatagctggaggcatgctaatagcatgttatgtcatatccggaagctcagctgatttatcattggacaaagcggctgaagtatcctgggaacaagaagcagaacactccggtgcctcacacaacatatcagtagaggtccaagatgatggaactatgaaaataaaagatgaagagagggatgacacactcaccatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttgggcaggtcccaagtaggagtgggagtcttccaagacggcgtgttccacacaatgtggcacgtcaccaggggagctgtccttatgtaccaagggaagaggctggaaccaagctgggcctgtgtcaaaaaggacttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggcgaagttggagccatagctctagatttcaaacccggcacatctggatctcccattgtgaacagagagggaaaaatagtgggtctttatggaaatggagtggtgacaacaagcggaacctacgtcagtgccattgcccaagctaaagcatcacaggaagggcctctaccagagattgaggacgaggtgtttaagaaaagaaacttaacaataatggacctgcacccaggatcagggaaaacaagaagatatcttccagccatagtccgtgaggccataaaaaggaaactgcgtacgttaatcctggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatctccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgattttccaggcaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtgatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttatatgggacagcctttaaataatgatgaggatcacgctcattggacagaagcaaaaatgctccttgacaatataaacacaccagaagggatcatcccagcccttttcgagccagagagagaaaagagtgcagcaatagatggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggatgccagaacatactctgatccactggccctgcgcgagtttaaagagtttgcagcaggaagaagaagtgtctcaggtgacctaatactggaaatagggaaacttccacaacatttgacgctaagagcccagaatgccctggacaacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtttagggaaaacatccattggcttgctctgtgtgacggcctcaagtgcactgttatggatggccagtgtggagccccattggatagcggcctccatcatactagagttctttttgatggtgctgctcattccagagccagacagacagcgcactccacaggacaaccagctagcatatgtggtgataggcttgttattcatgatacttacagtggcagccaatgagatgggattattggaaaccacaaagaaagacctggggattggctatgtagccgccgaaaaccaccaacatgctacaatgctggacgtagacctacacccagcttcagcctggaccctctatgcagtagccacaacagttatcactcccatgatgagacacacaattgaaaacacaacggcaaacatttccctgacagccattgcaaatcaggcagctatattgatgggacttgacaagggatggccaatatcgaagatggacataggagttccacttctcgccttagggtgctattcccaggtgaacccattgacgctgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtctatgatgtaaaatttgaaaaacagctaggccaaataatgttactgatactttgtacatcacagatcctcttgatgcggaccacatgggccttgtgtgaatccatcacactggctactggacccctgactactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaaccaatcatgcagtgtcgagaggaacagccaaactgaggtggtttgtggagaggaacctcgtgaaaccagaaggaaaagtcatagacctcggttgtggaagaggtggctggtcatattattgtgctgggctgaagaaagttactgaagtgaagggatacacaaaaggaggacctggacatgaggagcctatcccaatggcgacctatggatggaacctagtaaagctacactctggaaaagatgtatttttcatgccacctgagaaatgtgacacccttctgtgtgatattggtgagtcctctccgaatccaaccatagaagaaggaagaacgttacgtgttctaaaaatggtggaaccatggctcagaggaaaccaattctgcataaaaatcttaaatccttacatgccaagtgtggtagaaactcttgagcaaatgcaaagaaaacatggagggatgctagtgcgaaacccactctcaagaaattctacccatgaaatgtattgggtttcatgtggaacaggaaacattgtgtcggcagtgaacatgacatccagaatgctactgaaccgattcacaatggctcacaggaagccaacatatgaaagagatgtggacttaggcgctggaacaagacatgtgacagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgtacaccaagagcaaaacgaggcacaacacaaattatggaggtgacagccaagtggttatggggtttcctttccagaaacaaaaaacccagaatctgcacaagagaggagttcacaagaaaggtcaggtcaaacgcggcaataggggcagtgttcgttgacgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttttggagttcgaagcccttggtttcatgaatgaagatcactggtttagtagagagaattcactcagtggagtggaaggagaaggactgcacaaactcggatacatactcagagacatatcaaagattccggggggaaacatgtatgcagatgatacagccggatgggacacaagaataacagaggatgatctccagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgaccagagaggaagtggacaggtcggaacttatggcttaaatactttcaccaatatggaggtccaactaataagacaaatggagtctgaaggaatctttttacccagcgaattggaaacccccaacctagctgagagagttcttgactggttagaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagatctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctggattacatgacatcaatgaagagattcaagaatgagagtgatcccgaaggagcactctggtaa

SEQ ID NO: 5620 - RNA, 9879 nt, synthetic construct
  misc_feature 1..9879: note = derived and/or modified CDS sequence (wt) from DENV-1__FJ639824__SS-prME
  source 1..9879: mol_type = other RNA
tccgtgaccatgctcctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacctgggctttgagacacccaggattcacggtgatagccctttttttagcacatgctataggaacatccatcactcagaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaacggctgcggactattcggaaagggaagtctattgacgtgtgccaagttcaagtgtgtgacaaaactagaaggaaagatagttcaatatgagaacttaaaatattcagtgatagttaccgtccacactggggaccagcatcaggtgggaaacgagaccacagaacatggaacaattgcaaccataacacctcaagctcctacgtcggaaatacagctgaccgactacggagcccttacattggactgctcacctagaacagggctggactttaatgagatggtgctattgacaatgaaagaaaaatcatggcttgtccacaaacaatggtttctagacttaccactgccatggacctcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagactaaaaatggataaactgactttaaaggggatgtcatatgtgatgtgcacaggctcattcaagctagagaaggaagtggctgagacccagcatggaactgttctagtgcaggtcaaatacgaaggaacagacgcgccatgcaagatccccttctcgactcaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagaaaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgttcagcggtgtttcttggaccatgaaaataggaatagggattctgttgacatggttgggattaaattcaaggagcacgtcactttcgatgacgtgcattgcagttggcatggtcacactgtacctaggagtcatggttcaagcggactcgggatgtgtgatcaactggaagggcagagaacttaaatgtggaagtggcatttttgtcactaatgaagtccacacttggacagagcaatacaaattccaggctgactccccaaaaagactgtcagcagccattggaaaggcatgggaggagggagtgtgtggaattcgatcagccacgcgtcttgagaacatcatgtggaagcaaatatcaaatgaattgaaccacattctacttgaaaatgatatgaaattcacagtggttgtaggagatgctaacggaattttggcccaagggaaaaaaatgattaggccacaacccatggaacacaaatactcatggaaaagctggggaaaagctaaaatcataggagcagacatacaaaataccacctttatcatcgacggcccagacaccccagaatgtcccgatggccaaagagcatggaacatttgggaagttgaggactatgggtttggaattttcacgacaaacatatggctgaaattgcgtgactcctacacccaaatgtgtgaccaccggctaatgtcagctgccatcaaggacagcaaggcagttcatgctgacatggggtactggatagaaagtgaaaagaacgaaacctggaagctggcgagagcctccttcatagaagtcaagacatgcacctggccaaaatctcacactctatggagcaatggagttttggaaagtgaaatgataatcccaaagatatacggaggaccaatatctcagcacaactacaggccagggtatttcacacaaacagcagggccatggcacctaggtaagttggaactggattttgacttgtgtgaaggcaccacagttgttgtggatgaacattgtggaaatcgaggtccatctctcagaactacaacagtcacaggaaagataatccatgaatggtgttgcagatcctgcacgttaccccccttacgcttcagaggagaagacggatgttggtatggtatggaaatcagaccagtaaaggagaaggaggagaatctagttaggtcaatggtctctgcagggtcaggagaagtggacagtttttcattaggaatactatgcgtgtcaataatgattgaagaagtgatgagatctagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagattaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttactgtctttgacatttgtcaaaacaactctctcattggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactcctaaaaaatgatgtgccattggccggcccactagtagctggaggcatgctaatagcatgttatgtcatatccggaagctcagccgatttatcattggagaaagcggctgaggtgtcctgggaacaagaagcagaacactccggtgcttcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttgggcaggtcccaagtaggagtgggagtcttccaagacggcgtgttccacacaatgtggcatgtcaccaggggagctgtccttatgtaccaagggaagaggctggaaccaagctgggccagcgtcaaaaaggacttgatctcatatggaggaggttggagatttcaaggatcatggaacacgggagaagaagtgcaggtgatagctgttgaaccaggaaaaaaccccaaaaatgtacagacaacgccgggtaccttcaagactcctgaaggcgaagttggagccatagctctagatttcaaacccggcacatctggatctcccattgtgaacagagagggaaaaatagtgggtctttatggaaatggagtggtgacaacaagtggaacctacgtcagtgccattgcccaagctaaagcatcacaggaagggccgctaccagagattgaggacgaggtgtttaagaaaagaaacttaacaataatggacctgcacccaggatcaggaaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccatgctacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgttccaagcattaaatcaggaaatgacattgccaactgtttaagaaagaacggaaaacgggtaatccaactgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagagaagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggatgccagaacatactctgatccactggctctgcgcgagtttaaagagtttgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacacgctatggaggaactaccagacaccatagaaacattgatgcttctagctttgatagctgtgttgactggtggagtgacgctattcttcctatcaggaaaaggtttagggaaaacatctattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtctgttattcatgatactgacagtggcagccaatgagatgggattattggaaaccacaaagaaagacctggggattggctatgtagccgccgaaaaccaccaacacgctacaatgctggacgtagacctacgcccagcttcagcctggaccctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggactacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttttcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactgaaaaggggagaaacaaccaaacatgcagtgtcgagaggaacagccaaactgaggtggtttgtggagaggaacctcgtgaaaccagaaggaaaagtcatagacctcggttgtggaagaggtggctggtcatactattgtgctgggctgaagaaagttactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttctaaaaatggtggaaccatggctcaaaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatattattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcggcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccagggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgaccagagaggaagtggacaggtcggaacttatggcttaaatactttcaccaatatggaggtccaactaataagacaaatggagtctgaaggaatctttttacccagcgaattggaaactcccaacctagctgagagagttcttgactggttggaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggagccttcaaaaggatggaatgattggcagcaagtgcctttctgttcacaccatttccaccagctgatcatgaaggatgggagggaaatagtggtgccatgccgcaaccaagatgaacttgtgggcagggccagagtatcgcaaggcgccggatggagcctgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcctgaaggagcactctggtaa

SEQ ID NO: 5621 - RNA, 9879 nt, synthetic construct
  misc_feature 1..9879: note = derived and/or modified CDS sequence (wt) from DENV-1__JN819425__SS-prME
  source 1..9879: mol_type = other RNA
tccgtgaccatgctcctcatgctgctgcccacagccctggcgtttcatttgaccacacgagggggagagccacacatgatagttagtaagcaggaaagaggaaagtcactcttgtttaagacctctgcgggcgtcaatatgtgcaccctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggaaacaaatacaaagagtggaaacttgggctttgagacacccaggattcacggtgatagctttttttttagcacatgctataggaacatccatcactcaaaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgcggactattcggaaagggaagtctattgacgtgtgccaagttcaagtgtgtgacaaaactagaaggaaagatagttcaatatgaaaacttaaaatattcagtgatagtcactgtccacactggggaccagcaccaggtgggaaacgagaccacagaacatggaacaattgcaaccataacacctcaagctcccacgtcggaaatacagctgaccgactacggagccctcacattggactgctcacctagaacagggctggactttaatgagatggtgctattgacaatgaaagaaaaatcatggcttgtccacaaacaatggtttctagacttaccactgccatggacttcgggggcttcaacatctcaagagacttggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagactaaaaatggataaactgaccttaaaggggatgtcatatgtgatgtgcacaggctcatttaagctagagaaggaagtggctgagacccagcatggaactgttctagtgcaggtcaaatatgaaggaacagacgcgccatgcaagatccccttttcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgtttagcggtgtttcttggaccatgaaaataggaatagggattctgctgacatggttgggattaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtgtgtggaattcgatcagccacgcgtcttgagaacatcatgtggaagcaaatatcaaatgaattgaaccacattctacttgagaatgacatgaaattcacagtggttgtaggagatgccaacggaattttggcccaaggaaaaaaaatgattaggccacaacccatggaacacaaatactcatggaaaagctggggaaaagctaaaatcataggagcagacatacaaaatactaccttcatcatcgacggcccagacaccccagaatgtcccgatggccaaagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacagcagggccatggcacctaggtaagttggaactggattttgacttgtgtgaaggtaccacagttgttgtggatgaacattgtggaaatcgaggtccatctctcagaaccacaacagtcacaggaaagataatccatgaatggtgttgcagatcctgcacgctaccccccttacgtttcagaggagaagacgggtgttggtatggcatggaaatcagaccagtaaaggagaaggaggagaatctagtcaggtcaatggtctctgcagggtcaggagaagtggatagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttattgtctctgacatttgtcaaaacaactctctcattggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagctcactcctcaagaatgatgtgccgttggccgggccactaatagctggaggcatgctaatagcatgttatgtcatatccggaagctcagccgatttatcattggagaaagcggtgaaaatatcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttggggaggtcccaagtaggagtgggagtcttccaagacggcgtgttccacacaatgtggcacgttaccaggggagctgtccttatgtaccaagggaagagactggaaccaagctgggccagtgtcaaaaaggacttgatctcatatggaggaggttggaggttccaaggatcatggaacacaggagaagaagtgcaggtgatagctgttgaaccaggaaaaaaccccaaaaatgtacagacaacgccgggcaccttcaagactcctgaaggcgaagttggagccatagctctagatttcaaacccggcacatctggatctcccattgtgaacagagagggaaaaatagtgggtctgtatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcagggaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctttttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggacgccagaacatactctgatccattggccctgcgcgagtttaaagagttcgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgctacaatgctggacgtagacctacacccagcttcagcctggaccctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaagctacactctggaaaggatgtattttttatgccacctgagaaatgtgacacccttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacagattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgatcagagaggaagtggacaggtcggaacttatggcttaaatactttcaccaatatggaggtccaactaataagacaaatggagtctgaaggaatctttttacccagcgaattggaaacccccaacctagctgagagggctcttgactggttagaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcaaaaggatggaatgattggcagcaagtgcctttttgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctaggaaaaagggaagaccaatggtgtggatccctgataggcttgacagcgagggccacctgggccaccaacatacaagtagccataaaccaagtgagaaggctcatcgggaatgagaattatttagattacatgacatcaatgaagagattcaagaatgagagtgatcccgaaggagcactctggtaa

SEQ ID NO: 5622 - RNA, 9879 nt, synthetic construct
  misc_feature 1..9879: note = derived and/or modified CDS sequence (wt) from DENV-1__FJ850099__SS-prME
  source 1..9879: mol_type = other RNA
tccgtgaccatgctcctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacctgggctttgagacacccaggattcacggtgatagccctttttttggcacatgctataggaacatccatcactcagaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaacggctgcggactattcggaaagggaagtctattgacgtgtgccaagttcaagtgtgtgacaaaactagaaggaaagatagttcaatatgagaacttaaaatattcagtgatagttaccgtccacactggggaccagcatcaggtgggaaacgagaccacagaacatggaacaattgcaaccataacacctcaagctcctacgtcggaaatacagctgaccgactacggagcccttacattggactgctcacctagaacagggctggactttaatgagatggtgctattgacaatgaaagaaaaatcatggcttgtccacaaacaatggtttctagacttaccactgccatggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagactaaaaatggataaactgactttaaaggggatgtcatatgtgatgtgcacaggctcattcaagctagagaaggaagtggctgagacccagcatggaactgttctagtgcaggtcaaatacgaaggaacagacgcgccatgcaagatccccttctcgactcaagatgagaaaggagtgacccagaatgggagattgataacagccaatcccatagtcactgacaaagaaaaaccagtcaacattgagacagaaccaccttttggtgagagctacatcgtggtaggggcaggcgaaaaagctttgaaactaagctggttcaagaaaggaagcagcatagggaaaatgttcgaagcaaccgcccgaggagcacgaaggatggctatcctgggagacaccgcatgggacttcggttctataggaggagtgttcacatctgtgggaaaattggtacaccaggtttttggaaccgcatatggggttctgttcagcggtgtttcttggaccatgaagataggaatagggattctgttgacatggttgggattaaattcaaggagcacgtcactttcgatgacgtgcattgcagttggcatggtcacactgtacctaggagtcatggttcaagcggactcgggatgtgtgatcaactggaagggcagagaacttaaatgtggaagtggcatttttgtcactaatgaagtccacacttggacagagcaatacaaattccaggctgactccccaaaaagactgtcagcagccattggaaaggcatgggaggagggagtgtgtggaattcgatcagccacgcgtcttgagaacattatgtggaagcaaatatcaaatgaattgaaccacattctacttgaaaatgatatgaaattcacagtggttgtaggagatgctaacggaattttggcccaagggaaaaaaatgattaggccacaacccatggaacacaaatactcatggaaaagctggggaaaagctaaaatcataggagcagatatacaaaataccacctttatcatcgacggcccagacaccccagaatgtcccgatggccaaagagcatggaacatttgggaagttgaggactatgggtttggaattttcacgacaaacatatggctgaaattgcgtgactcctacacccaaatgtgtgaccaccggctaatgtcagctgccatcaaggacagcaaggcagttcatgctgacatggggtactggatagaaagtgaaaagaacgaaacctggaagctggcgagagcctccttcatagaagtcaagacatgcacctggccaaaatctcacactctatggagcaatggagttttggaaagtgaaatgataatcccaaagatatatggaggaccaatatctcagcacaactacaggccagggtatttcacacaaacagcagggccatggcacctaggtaagttggaactggattttgacttgtgtgaaggcaccacagttgttgtggatgaacattgtggaaatcgaggtccatctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggccactttcaaaatgagaccaatgttcgctgttgggctattattccgcagattaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttactgtctttgacatttgtcaaaacaactctctcattggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactcctaaaaaatgatgtgccattggccggcccactaatagctggaggcatgctaatagcatgttatgtcatatccggaagctcagccgatttatcattggagaaagcggctgaggtgtcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagtccttgatgatggcatctatagaatcttgcaaagaggactgttgggcaggtcccaagtaggagtgggagtcttccaagacggcgtgttccacacaatgtggcatgtcaccaggggagctgtccttatgtaccaagggaagaggctggaaccaagctgggccagtgtcaaaaaggacttgatctcatatggaggaggttggagatttcaaggatcatggaacacgggagaagaagtgcaggtgatagctgttgaaccaggaaaaaaccccaaaaatgtacagacaacgccgggtaccttcaagactcctgaaggcgaagttggagccatagctctagatttcaaacccggcacatctggatctcccattgtgaacagagaggggaaaatagtgggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcaggaaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgttccaagcattaaatcaggaaatgacattgccaactgtttaagaaagaacggaaaacgggtaatccaactgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagagaagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggatgccagaacatactctgatccactggctctgcgcgagtttaaagagtttgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacacgctatggaggaactaccagacaccatagaaacattgatgcttctagctttgatagctgtgttgactggtggagtgacgctattcttcctatcaggaaaaggtttagggaaaacatctattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacacgctacaatgctggacgtagacctacgcccagcttcagcctggaccctctatgcagtagccacaacagttatcactcccatgatgagacacacaattgaaaatacaacggcaaacatttccctgacagccattgcaaatcaggcagctatattgatggggcttgacaagggatggccaatatcgaagatggacataggagttccacttcttgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctttgggagggatctccaggaaaattctggaataccacgatagcagtgtccatggcaaacatcttcaggggaagttatctagcaggagcaggtttggctttttcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaaggaaaagtcatagacctcggttgtggaagaggtggctggtcatactattgtgctgggctgaagaaagttactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttctaaaaatggtggaaccatggctcaaaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatattattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcggcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccagggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgaccagagaggaagtggacaggtcggaacttatggcttaaatactttcaccaatatggaggtccaactaataagacaaatggagtctgaaggaatctttttatccagcgaattggaaactcccaacctagctgagagagttcttgactggttggaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggagccttcaaaaggatggaatgattggcagcaagtgcctttttgttcacaccatttccatcagctgatcatgaaggatgggagggaaatagtggtgccatgccgcaaccaagatgaacttgtgggcagggccagagtatcgcaaggcgccggatggagcctgagagagactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcctgaaggagcactctggtaa

SEQ ID NO: 5623 - RNA, 9879 nt, synthetic construct
  misc_feature 1..9879: note = derived and/or modified CDS sequence (wt) from DENV-1__FJ850100__SS-prME
  source 1..9879: mol_type = other RNA
tccgtgaccatgctcctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccggattactgaggcggaaccagatgacgttgactgctggtgcaacgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacctgggctttgagacacccaggattcacggtgatagccctttttttagcacatgctataggaacatccatcactcagaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacaaatcctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaacggctgcggactattcggaaagggaagtctattgacgtgtgccaagttcaagtgtgtgacaaaactagaaggaaagatagttcaatatgagaacttaaaatactcagtgatagttaccgtccacactggggaccagcatcaggtggggaacgagaccacagaacatggaacaattgcaaccataacacctcaagctcctacgtcggaaatacagctgaccgactacggagcccttacattggactgctcacctagaacagggctggactttaatgagatggtgctattgacaatgaaagaaaaatcatggcttgtccacaaacaatggtttctagacttaccactgccatggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagactaaaaatggacaaactgactttaaaggggatgtcatatgtgatgtgcacaggctcattcaagctagagaaggaagtggctgagacccagcatggaactgttctagtgcaggtcaaatacgaaggaacagacgcgccatgcaagatccccttctcgactcaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagaaaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgttcagcggtgtttcttggaccatgaaaataggaatagggattctgttgacatggttgggattaaattcaaggagcacgtcactttcgatgacgtgcattgcagttggcatggtcacactgtacctaggagtcatggttcaagcggactcgggatgtgtgatcaactggaagggcagagaacttaaatgtggaagtggcatttttgtcactaatgaagtccacacttggacagagcaatacaaattccaggctgactccccaaaaagactgtcagcagccattggaaaggcatgggaggagggagtgtgtggaattcgatcagccacgcgtcttgagaacattatgtggaagcaaatatcaaatgaattgaaccacattctacttgaaaatgatatgaaattcacagtggttgtaggagatgctaacggaattttggcccaagggaaaaaaatgattaggccacaacccatggaacacaaatactcatggaaaagctggggaaaagctaaaatcataggagcagacatacaaaataccacctttatcatcgacggcccagacaccccagaatgtcccgatggccaaagagcatggaacatttgggaagttgaggactatgggtttggaattttcacgacaaacatatggctgaaattgcgtgactcctacacccaaatgtgtgaccaccggctaatgtcagctgccatcaaggacagcaaggcagttcatgctgacatggggtactggatagaaagtgaaaagaacgaaacctggaagctggcgagagcctccttcatagaagtcaagacatgcacctggccaaaatctcacactctatggagcaatggagttttggaaagtgaaatgataatcccaaagatatatggaggaccaatatctcagcacaactacaggccagggtatttcacacaaacagcagggccatggcacctaggtaagttggaactggattttgacttgtgtgaaggcaccacagttgttgtggatgaacattgtggaaatcgaggtccatctcttagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgcacctagccttgatggctactttcaaaatgagaccaatgttcgctgttgggctattattccgcagattaacatccagagaagttcttctcctcacgattggattaagcctgatggcatccatggagctaccaaattctttggaggagctaggggatggacttgcaatgggtatcatgatgttaaaattgttgactgaatttcagccacaccagttatggaccaccttactgtctttgacatttgtcaaaacaactctctcattggattatgcatggaaaacaacggctatgatactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactcctaaaaaatgatgtgccattggccggcccactaatagctggaggcatgctaatagcatgttatgtcatatccggaagctcagccgatttatcattggagaaagcggctgaggtgtcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttgggcaggtcccaagtaggagtgggagtcttccaagacggcgtgttccacacaatgtggcacgtcaccaggggagctgtccttatgtaccaagggaagaggctggaaccaagctgggccagtgtcaaaaaggacttgatctcatatggaggaggttggagatttcaaggatcatggaacacgggagaagaagtgcaggtgatagctgttgaaccaggaaaaaaccccaaaaatgtacagacaacgccgggtaccttcaagactcctgaaggcgaagttggagccatagctctagatttcaaacccggcacatctggatctcccattgtgaacagagagggaaaaatagtgggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcaggaaaaacaagaagatatcttccagccatagtccgtgaggccataaaaaggaaactgcgtacgttaatcttggctcccacaagagtcgttgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcaccgactttccaggtaaaacagtctggtttgttccaagcattaaatcaggaaatgacattgccaactgtttaagaaagaacggaaaacgggtaatccaactgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagagaagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcggcctcgctggttggatgccagaacatactctgatccactggctctgcgcgagtttaaagagtttgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacacgctatggaggaactaccagacaccatagaaacattgatgcttctagctttgatagctgtgttgactggtggagtgacgctattcttcctatcaggaaaaggtttagggaaaacatctattggcttgctctgtgtgacggcctcaagcacactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacacgctacaatgctggacgtagacctacgcccggcttcagcctggaccctctatgcagtagccacaacagttatcactcccatgatgagacatacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttagatcctgtggtttatgatgcaaaatttgaaaaacagctaggccaaataatgttactgatactttgtacatcacagatcctcttgatgcggaccacatgggccttgtgtgaatccattacactggctactggacccctgaccactctctgggagggatctccaggaaaattctggaataccacgatagcagtgtccatggcaaacatcttcaggggaagttatctagcaggagcaggtctggctttttcattaatgaaatctttaggaggaggtaggagaggtacgggagctcaaggggaaacactgggagagaagtggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaaggaaaagtcatagacctcggttgtggaagaggtggctggtcatactattgtgctgggctgaagaaagttactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttctaaaaatggtggaaccatggctcaaaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacaaattatggaggtgacagccaagtggttatggggtttcctttccagaaacaaaaagcccagaatctgcacaagagaggagttcacaagaaaagttaggtcaaacgcggcaataggagcagtgttcgttgatgaaaaccaatggaactcggcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccagggggaaatatgtatgcagatgatacagccggatgggacacaagaataacagaggatgatcttcagaatgaggctaaaatcactgacatcatggagccagaacatgctctattggctacgtcaatttttaagctgacttatcaaaacaaggtggtgagggtgcaaagaccagcaaaaaatggaaccgtgatggatgttatatccagacgtgaccagagaggaagtggacaggtcggaacttatggcttaaatactttcaccaatatggaggtccaactaataagacaaatggagtctgaaggaatctttttacccagcgaattggaaactcccaacctagctgagagagttcttgactggttggaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggagccttcaaaaggatggaatgattggcagcaagtgcctttctgttcacaccatttccaccagctgatcatgaaggatgggagggaaatagtggtgccatgccgcaatcaagatgaacttgtgggcagggccagagtatcgcaaggcgccggatggagcctgagagaaactgcttgcctaggcaagtcatatgcacaaatgtggcagctgatgtacttccacaggagagacctgagactagcggctaacgccatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcctgaaggagcactctggtaa

SEQ ID NO: 5624 - RNA, 9879 nt, synthetic construct
  misc_feature 1..9879: note = derived and/or modified CDS sequence (wt) from DENV-1__FJ882579__SS-prME
  source 1..9879: mol_type = other RNA
tccgtgaccatgctcctcatgctattgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacctgggccttgagacacccaggattcacggtgatagccttttttttagcacatgctataggaacatccatcactcagaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaacggctgcggactattcggaaagggaagtctattgacgtgtgccaagttcaagtgtgtgacaaaactagaaggaaagatagttcaatatgagaacttaaaatattcagtgatagttaccgtccacactggggaccagcatcaggtgggaaacgagaccacagaacatggaacaattgcaaccataacacctcaagctcctacgtcggaaatacagctgaccgactacggagcccttacattggactgctcacctagaacagggctggactttaatgagatggtgctattgacaatgaaagaaaaatcatggcttgtccacaaacagtggtttctagacttaccactgccatggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagactaaaaatggataaactgactttaaaggggatgtcatacgtgatgtgcacaggctcattcaagttagagaaggaagtggctgagacccagcatggaactgttctagtgcaggtcaaatacgaaggaacagacgcgccatgcaagatccccttctcgactcaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagaaaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgttcagcggtgtttcttggaccatgaaaataggaatagggattctgttgacatggttgggattaaattcaaggagcacgtcactttcgatgacgtgcattgcagttggcatggtcacactgtacctaggagtcatggttcaagcggactcgggatgtgtgatcaactggaagggcagagaacttaaatgtggaagtggcatttttgtcactaatgaagtccacacttggacagagcaatacaaattccaggctgactccccaaaaagactgtcagcagccattggaaaggcatgggaggagggagtgtgtggaattcgatcagccacgcgtcttgagaacatcatgtggaagcaaatatcaaatgaattgaaccacattctacttgaaaatgatatgaaattcacagtggttgtaggagatgctaacggaattttgacccaaggaaaaaaaatgattaggccacaacccatggaacacaaatactcatggaaaagctggggaaaagctaaaatcataggagcagacatacaaaataccacctttatcatcgacggcccagacaccccagaatgtcccgatggccaaagagcatggaacatttgggaagttgaggactatgggtttggaattttcacgacaaacatatggctgaaattgcgtgactcttacacccaaatgtgtgaccaccggctaatgtcagctgccatcaaggacagcaaggcagttcatgctgacatggggtactggatagaaagtgaaaagaacgaaacctggaagctggcgagagcctccttcatagaagtcaagacatgcacctggccaaaatctcacactctatggagcaatggagttttggaaagtgaaatgataatcccaaagatatatggaggaccaatatctcagcacaactacaggccagggtatttcacacaaacagcagggccatggcacctaggtaagttggaactggattttgacttgtgtgaaggcaccacagttgttgtggatgaacattgtggaaatcgaggtccatctctcagaactacaacagtcacaggaaagataatccatgaatggtgttgcagatcctgcacgttaccccccttacgtttcagaggagaagacggatgttggtatggcatggaaatcagaccagtgaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagattaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttactgtctttgacatttgtcaaaacaactctctcattggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactcctaaaaaatgatgtgccattggccggcccactaatagctggaggcatgctaatagcatgttatgtcatatccggaagctcagccgatttattattggagaaagcggctgaggtgtcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttgggcaggtcccaagtaggagtgggagtcttccaagacggcgtgttccacacaatgtggcacgtcaccaggggagctgtccttatgtaccaagggaagaggctggaaccaagctgggccagtgtcaaaaaggacttgatctcatatggaggaggttggagatttcaaggatcatggaacacgggagaagaagtgcaggtgatagctgttgaaccaggaaaaaaccccaaaaatgtacagacaacgccgggtaccttcaagactcctgaaggcgaagttggagccatagctctagatttcaaacccggcacatctggatctcccattgtgaacagagagggaaaaatagtgggtctttatggaaatggagtggtgacaacaagtggaacctacgtcagtgccattgcccaagccaaagcatcacaggaagggcctctaccagagattgaggacgaggtgtttaagaaaagaaacttaacaataatggatctgcacccaggatcaggaaaaacaagaagatatcttccagccatagtccgtgaggccataaaaaggaaactgcgtacgttaatcttggctcccacaagagtcgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaagcctttccacagagcaatgcagttatccaagatgaggaaagagacattcctgagagatcatggaactcaggctacgactggatcactgattttccaggtaaaacagtctggtttgttccaagcattaaatcaggaaatgacattgccaactgtttaagaaagaacggaaaacgggtaatccaactgagcagaaaaacctttgacactgagtaccagaaaacaaaaaacaatgactgggactatgttgtcacaacggacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagagaagaggaagaattggaaggaaccaaaacaaggaaggtgatcagtatgtttacatgggacagcctttaaataatgatgaggatcacgctcattggacagaagcaaaaatgctccttgacaacataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggatgccagaacatactctgatccactggctctgcgcgagtttaaagagtttgcagcaggaagaagaagtgtctcaggtgacctaatattggaaatagggaaacttccacaacatttgacgctaagagcccagaatgctctggacaacttggtcatgttgcacaactccgaacaaggaggaaaagcctacagacacgctatggaggaactaccagacaccatagaaacattgatgcttctagctttgatagctgtgttgactggtggagtgacgctattcttcctatcaggaaaaggtttagggaaaacatctattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacacgctacaatgctggacgtagacctacgcccagcttcagcctggaccctctatgcagtagccacaacagttatcactcccatgatgagacacacaattgaaaatacaacggcaaacatttccctgacagccattgcaaatcaggcagctatattgatgggacttgacaagggatggccaatatcgaaaatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactctgtacatcacagatcctcttgatgcggaccacatgggccttgtgtgaatccatcacactggctactggacccctgaccactctctgggagggatctccaggaaaattctggaataccacgatagcagtgtctatggcaaacatcttcaggggaagttatctagcaggagcaggtctggctttttcattaatgaaatctttaggaggaggtaggagaggcacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaaggaaaagtcatagacctcggttgtggaagaggtggctggtcatactattgtgctgggctgaagaaagttactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgctacgtgttctaaaaatggtggaaccatggctcaaaggaaaccaattctgcataaaaatcctaaatccttacatgccaagtgtggtagagactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatattattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcggcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccagggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgaccagagaggaagtggacaggtcggaacttatggcttaaatactttcaccaatatggaggtccaactaataagacaaatggagtctgaaggaatctttttacccagcgaattggaaactcccaacctagctgagagagttcttgactggttggaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggagccttcaaaaggatggaatgattggcagcaagtgcctttctgttcacaccatttccaccagctgatcatgaaggatgggagggaaatagtggtgccatgccgcaaccaagatgaacttgtgggcagggccagagtatcgcaaggcgccggatggagcctgagagaaactgcttgcctaggcaagtcatatgcacaaatgtggcagctgatgtacttccacaggagagacctgagactagcggctaacgctatctgttcagccgttccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcctgaaggagcactctggtaa

SEQ ID NO: 5625 - RNA, 9879 nt, synthetic construct
  misc_feature 1..9879: note = derived and/or modified CDS sequence (wt) from DENV-1__JN819414__SS-prME
  source 1..9879: mol_type = other RNA
tccgtgaccatgctcctcatgctgttgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacctgggctttgagacacccaggattcacggtgatagccctttttttagcatatgctataggaacatccatcactcagaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacactaccaccgattcaagatgtccaacacaaggagaggctacactggtggaagaacaagacgcgaactttgtgtgtcgccgaacgtttgtggacagaggctggggtaacggctgcggactattcggaaagggaagtctattgacgtgtgccaagttcaagtgtgtgacaaaactagaaggaaagatagttcaatatgagaacttaaaatattcagtgatagttaccgtccacactggggaccagcatcaggtgggaaacgagaccacagaacatggaacaattgcaaccataacacctcaagctcctacgtcggaaatacagctgaccgactacggagcccttacattggactgctcacctagaacagggctggactttaatgagatggtgctattgacaatgaaagaaaaatcatggcttgtccacaaacagtggtttctagacttaccactgccatggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagactaaaaatggataaactgactttaaaggggatgtcatatgtgatgtgcacaggctcattcaagttagagaaggaagtggctgagacccagcatggaactgttctagtgcaggtcaaatacgaaggaacagacgcgccatgcaagatccccttctcgactcaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagaaaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgttcagcggtgtttcttggaccatgaaaataggaatagggattctgttgacatggttgggattaaattcaaggagcacgtcactttcgatgacgtgcattgcagttggcatggtcacactgtacctaggagtcatggttcaagcggactcgggatgtgtgatcaactggaagggcagagaacttaaatgtggaagtggcatttttgtcactaatgaagtccacacttggacagagcaatacaaattccaggctgactccccaaaaagactgtcagcagccattggaaaggcatgggaggagggagtgtgtggaattcgatcagccacgcgtcttgagaacatcatgtggaagcaaatatcaaatgaattgaaccacattctacttgaaaatgatatgaaattcacagtggttgtaggagatgctaacggaattttggcccaagggaaaaaaatgattaggccacaacccatggaacacaaatactcatggaaaagctggggaaaagctaaaatcataggagcagacatacaaaataccacctttatcatcgacggcccagacaccccagaatgtcccgatggccaaagagcatggaacatttgggaagttgaggactatgggtttggaattttcacgacaaacatatggctgaaattgcgtgactcctacacccaaatgtgtgaccaccggctaatgtcagctgccatcaaggacagcaaggcagttcatgctgacatggggtactggatagaaagtgaaaagaacgaaacctggaagctggcgagagcctccttcatagaagtcaagacatgcacctggccaaaatctcacactctatggagcaatggagttttggaaagtgaaatgataatcccaaagatatatggaggaccaatatctcagcacaactacaggccagggtatttcacacaaacagcagggccatggcacctaggtaagttggaactggattttgacttgtgtgaaggcaccacagttgttgtggatgaacattgtggaaatcgaggtccatctctcagaactacaacagtcacaggaaagataatccatgaatggtgttgcagatcttgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgtttttctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagattaacatccagagaagttctcctcctcacgattggattaagcctggtggcatccgtggagctaccaaattctttggaggagctaggggatggacttgcaatgggtatcatgatgttaaaattgttgactgaatttcagccacaccagttatggaccaccttactgtctttgacatttgtcaaaacaactctctcattggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactcctaaaaaatgatgtgccattggccggcccactaatagctggaggcatgctaatagcatgttatgtcatatccggaagctcagccgatttattattggagaaagcggctgaggtgtcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttgggcaggtcccaagtaggagtgggagtcttccaagacggcgtgttccacacaatgtggcacgtcaccaggggagctgtccttatgtaccaagggaagaggctggaaccaagctgggccagtgtcaaaaaggacttgatctcatatggaggaggttggagatttcaaggatcatggaacacgggagaagaagtgcaggtgatagctgttgaaccaggaaaaaaccccaaaaatgtacagacaacgccgggtaccttcaagactcctgaaggcgaggttggagccatagctctagatttcaaacccggcacatctggatctcccattgtgaacagagagggaaaaatagtgggtctttatggaaatggagtggtgacaacaggtggaacctacgttagtgccattgcccaagctaaagcatcacaggaagggcctctaccagagattgaggacgaggtgtttaagaaaagaaacttaacaataatggacctgcacccaggatcaggaaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacatttcaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgttccaagcattaaatcaggaaatgacattgccaattgtttaagaaagaacggaaaacgggtaatccaactgagcagaaaaacctttgacactgagtaccagaaaacaaaaaacaatgactgggactatgttgtcacaacggacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagagaagaggaagaattggaaggaaccaaaacaaggaaggtgatcagtatgtttacatgggacagcctttaaataatgatgaggatcacgctcattggacagaagcaaaaatgctccttgacaacataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggatgccagaacatactctgatccactggctctgcgcgagtttaaagagtttgcagcaggaagaagaagtgtctcaggtgacctaatattggaaatagggaaacttccacaacatttgacgctaagagcccagaatgctctggacaacttggtcatgttgcacaactccgaacaaggaggaaaagcctacagacacgctatggaggaactaccagacaccatagaaacattgatgcttctagctttgatagctgtgttgactggtggagtgacgctattcttcctatcaggaaaaggtttagggaaaacatctattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacacgctacaatgctggacgtagacctacgcccagcttcagcctggaccctctatgcagtagccacaacagttatcactcccatgatgagacacacaattgaaaatacaacggcaaacatttccctgacagccattgcaaatcaggcagctatattgatgggacttgacaagggatggccaatatcgaaaatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaagcagctaggccaaataatgttactgatactctgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttttcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaaggaaaagtcatagacctcggttgtggaagaggtggctggtcatactattgtgctgggctgaagaaagttactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttctaaaaatggtggaaccatggctcaaaggaaaccaattctgcataaaaatcctaaatccttacatgccaagtgtggtagagactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatattattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacaaattatggaggtgacagccaagtggttatggggcttcctttccagaaacaaaaaacccagaatctgcacaagagaggagttcacaagaaaggttaggtcaaacgcggcaataggagcagtgttcgttgatgaaaaccaatggaacacggcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcacttagtggagtggaaggagaaggactgcacaaacttggatacatactcagagacatatcaaagattccagggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgaccagagaggaagtggacaggtcggaacttatggcttaaatacttttaccaatatggaggtccaactaataagacaaatggagtctgaaggaatctttttacccagcgaattggaaactcccaacctagctgagagagctcttgactggttggaaaaacatggcgccgaaaggctgaaacgaatggcaatcagcggagatgattgcgtggtgaaaccaattgacgacaggttcgcaacagccttgacagctctgaatgacatgggaaaagtaagaaaagacataccgcagtgggagccttcaaaaggatggaatgattggcagcaagtgcctttctgctcacaccatttccaccagctgatcatgaaggatgggagggaaatagtggtgccatgccgcaaccaagatgaacttgtgggcagggccagagtatcgcaaggcgccggatggagcctgagagaaactgcttgcctaggcaagtcatatgcacaaatgtggcagctgatgtacttccacaggagagacctgagactagcggctaacgctatctgttcagccgttccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcctgaaggagcactctggtaa

SEQ ID NO: 5626 - RNA, 9879 nt, synthetic construct
  misc_feature 1..9879: note = derived and/or modified CDS sequence (wt) from DENV-1__FJ873810__SS-prME
  source 1..9879: mol_type = other RNA
tccgtgaccatgctcctcatgctgctgcccacagccctggcgtttcatttgaccacacgagggggagagccacacatgatagttagtaagcaggaaagaggaaagtcactcttgtttaagacctctgtgggcgtcaatatgtgcaccctcattgcgatggacttgggagagttatgtgaggacacaatgacctacaaatgcccccggatcactgaggcggaaccagatgacgttgactgctggtgtaatgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggaaacaaatacaaagagtggaaacttgggctttgagacacccaggattcacggtgatagccttttttttagcacatgctataggaacatccatcactcaaaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgctgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgcggactattcggaaagggaagtctattgacgtgtgccaagttcaagtgtgtgacaaaactagaaggaaagatagttcaatatgaaaacttaaaatattcagtgatagtcactgtccacactggggaccagcaccaggtgggaaacgagaccacagaacatggaacaattgcaaccataacacctcaagctcccacgtcggaaatacagctgaccgactacggagccctcacattggactgctcacctagaacagggctggactttaatgagatggtgctattgacaatgaaagaaaaatcatggcttgtccacaaacaatggtttctagacttaccactgccatggacttcgggggcttcaacatctcaagagacctggaacagacaagatttgctggtcacattcaagacagctcatgcaaagaaacaggaagtagtcgtactgggatcacaggaaggagcaatgcacacagcgttgactggggcgacagaaatccagacgtcaggaacgacaacaatcttcgcaggacacctgaaatgcagactaaaaatggataaactgaccttaaaggggatgtcatatgtgatgtgcacaggctcatttaagctagagaaggaagtggctgagacccagcatggaactgttctagtgcaggtcaaatatgaaggaacagacgcgccatgcaagatccccttttcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgtttagcggtgtttcttggaccatgaaaataggaatagggattctgctgacatggttgggattaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtgtgtggaattcgatcagccacgcgtcttgagaacatcatgtggaagcaaatatcaaatgaattgaaccacattctacttgagaatgacatgaaattcacagtggttgtaggagatgccaacggaattttggcccaagggaaaaaaatgattaggccacaacctatggagcacaaatactcatggaaaagctggggaaaagctaaaatcataggagcagacatacaaaatactaccttcatcatcgacggcccagacaccccagaatgtcccgatggccaaagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacagcagggccatggcacctaggtaagttggaactggattttgacttgtgtgaaggtaccacagttgttgtggatgaacattgtggaaatcgaggtccatctctcagaaccacaacagtcacaggaaagataatccatgaatggtgttgcagatcctgcacgctaccccccttacgtttcagaggagaagacgggtgttggtatggcatggaaatcagaccagtaaaggagaaggaggagaatctagtcaggtcaatggtctctgcagggtcaggagaagtggatagtttttcattaggaatactatgcgtgtcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagactaacatccagagaagttcttctcctcactattggattaagcctggtggcatccgtggagctaccaaattctttggaggagctaggggatggacttgcaatgggtatcatgatgttaaaattgttgactgaatttcagccacaccagttatggaccaccttattgtctctgacatttgtcaaaacaactctctcactggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagctcactcctcaaaaatgatgtgccgttggccgggccactaatagctggaggcatgctaatagcatgttatgtcatatccggaagctcagccgatttatcattggagaaagcggctgaagtatcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttggggaggtcccaagtaggagtaggagtcttccaagacggcgtgttccacacaatgtggcacgttaccaggggagctgtccttatgtaccaagggaagagactggaaccaagctgggccagtgtcaaaaaggacttgatctcatatggaggaggttggaggttccaaggatcatggaacacaggagaagaagtgcaggtgatagctgttgaaccaggaaaaaaccccaaaaatgtacagacaacgccgggcaccttcaagactcctgaaggcgaagttggagccatagctctagatttcaaacccggcacatctggatctcccattgtgaacagagagggaaaaatagtgggtctgtatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcagggaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctttttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggacgccagaacatactctgatccattggccctgcgcgagtttaaagagttcgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgctacaatgctggacgtagacctacacccagcttcagcctggaccctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaagctacactctggaaaggatgtattttttatgccacctgagaaatgtgacacccttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatctagaatgttactgaaccgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacagattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaattaggagagtttggaaaagcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatacttagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgtcatatccagacgtgatcagagaggaagtggacaggtcggaacttatggcttaaatactttcaccaatatggaggtccaactaataagacaaatggagtctgaaggaatctttttacccagcgaattggaaacccccaacctagctgagagggctcttgactggctagaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcaaaaggatggaatgattggcagcaagtgcctttttgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctaggaaaaagggaagaccaatggtgtggatccctgataggcttgacagcgagggccacctgggccaccaacatacaagtagccataaaccaagtgagaaggctcatcgggaatgagaattatttagattacatgacatcaatgaagagattcaagaatgagagtgatcccgaaggagcactctggtaa

SEQ ID NO: 5627 - RNA, 9879 nt, synthetic construct
  misc_feature 1..9879: note = derived and/or modified CDS sequence (wt) from DENV-1__FJ850103__SS-prME
  source 1..9879: mol_type = other RNA
tccgtgaccatgctcctcatgctgctgcccacagccctggcgtttcatttgaccacacgagggggagagccacacatgatagttagtaagcaggaaagaggaaagtcactcttgtttaagacctctgcgggcgtcaatatgtgcaccctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagagaaacgttccgtggcactagccccacacgtgggacttggtctagaaacaagaaccgaaacatggatgtcctctgaaggcgcctggaaacaaatacaaagagtggaaacttgggctttgagacacccaggattcacggtgatagccttttttttagcacatgctataggaacatccattactcaaaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcactaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgtggactattcggaaagggaagtctattgacgtgtgccaagttcaagtgtgtgacaaaactagaaggaaagatagttcaatatgaaaacttaaaatattcagtgatagtcactgtccacactggggaccagcaccaggtgggaaacgagaccacagaacatggaacaattgcaaccataacacctcaagctcccacgtcggaaatacagctgaccgactacggagccctcacattggactgctcacctagaacagggctggactttaatgagatggtgctattgacaatgaaagaaaaatcatggcttgtccacaaacaatggtttctagacttaccactgccatggacttcgggggcttcaacatctcaagagacctggaacagacaagatttgctggtcacattcaagacagctcatgcaaagaaacaggaagtagtcgtactgggatcacaggaaggagcaatgcacacagcgttgactggggcgacagaaatccagacgtcaggaacgacaacaatcttcgcaggacacctgaaatgcagactaaaaatggataaactgaccttaaaggggatgtcatatgtgatgtgcacaggctcatttaagctagagaaggaagtggctgagacccagcatggaactgttctagtgcaggtcaaatatgaaggaacagacgcgccatgcaagatccccttctcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcataggaaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgtttagcggtgtttcttggaccatgaaaataggaatagggattctgctgacatggttgggattaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtgtgtggaattcgatcagccacgcgtcttgagaacatcatgtggaagcaaatatcaaatgaattgaaccacattctacttgagaatgacatgaaattcacagtggttgtaggagatgccaacggaattttggcccaaggaaaaaaaatgattaggccacaacccatggaacacaaatactcatggaaaagctggggaaaagctaaaatcataggagcagacatacaaaatactaccttcatcatcgacggcccagacaccccagaatgtcccgatggccaaagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcatctggccgaaatctcacactctatggagcaatggagttttggaaagtgaaatgataatcccaaagatatatggaggaccaatatctcagcacaactacagaccagggtatttcacacaaacagcagggccatggcacctaggtaagttggaactggattttgacttgtgtgaaggtaccacagttgttgtggatgaacattgtggaaatcgaggtccatctctcagaaccacaacagtcacaggaaagataatccatgaatggtgttgcagatcctgcacgctaccccccttacgtttcagaggagaagacgggtgttggtatggcatggaaatcagaccagtaaaggagaaggaggagaatctagtcaggtcaatggtctctgcagggtcaggagaagtggatagtttttcattaggaatactatgcgtgtcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagctttgatggctactttcaaaatgagaccaatgttcgctgttgggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttattgtctctgacatttgtcaaaacaactctctcactggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagctcactcctcaaaaatgatgtgccgttggccgggccactaatagctggaggcatgctaatagcatgttatgtcatatccggaagctcagccgatttatcattggagaaagcggctgaagtatcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagtcctccggaagtggaaagagcagttcttgatgatggcatctatagaatcttgcaaagaggactgttggggaggtcccaagtaggagtgggagtcttccaagacggcgtgttccacacaatgtggcacgttaccaggggagctgtccttatgtaccaagggaagagactggaaccaagctgggccagtgtcaaaaaggacttgatctcatatggaggaggttggaggttccaaggatcatggaacacaggagaagaagtgcaggtgatagctgttgaaccaggaaaaaaccccaaaaatgtacagacaacgccgggcaccttcaagactcctgaaggcgaagttggagccatagctctagatttcaaacccggcacatctggatctcccattgtgaacagagagggaaaaatagtgggtctatatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcagggaaaacaagaagatatcttccagccatagtccgtgagtccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctttttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggacgccagaacatactctgatccattggccctgcgcgagtttaaagagttcgcagcaggaagaagaagtgtctcaggtgacctaatattggaaatagggaaacttccacaacatttgacgctaagagcccagaatgctctggacaatttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgctacaatgctggacgtagacctacacccagcttcagcctggaccctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaacatcttcaggggaagttatctagcaggagcaggtctggctttctcattaatgaaatctttaggaggaggtaggagaggtacgggagctcaaggggaaacattgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaagctacactctggaaaggatgtattttttatgccacctgagaaatgtgacacccttctgtgtgatattggtgagtcctctccgaatccaaccatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgaaattgctcacaaaaccatgggatgttatccccatggtcacacaaatagctatgactgataccacaccctttggacaacagagagtgtttaaagagaaagttgacacgcgcacaccaagagcaaaacgaggcacaacacagattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaattttcaagctgacttatcaaaacaaggtggtgagggtgcaaagaccagcaaaaaatggaaccgtgatggatgttatatccagacgtgatcagagaggaagtggacaggtcggaacttatggcttaaatactttcaccaatatggaggtccaactaataagacaaatggagtctgaaggaatctttttacccagcgaattggaaacccccaacctagctgagagggctcttgactggttagaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcaaaaggatggaatgattggcagcaagtgcctttttgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccatcaatggatgacaacagaagacatgttatcagtgtggaatagggtttggatagaggaaaacccatggatggaggacaaaactcatgtatccagttgggaagaagttccatacctaggaaaaagggaagaccaatggtgtggatccctgataggcttgacagcgagggccacctgggccactaacatacaagtagccataaaccaagtgagaaggctcatcgggaatgagaattatttagattacatgacatcaatgaagagattcaagaatgagagtgatcccgaaggagcactctggtaa

SEQ ID NO: 5628 - RNA, 9879 nt, synthetic construct
  misc_feature 1..9879: note = derived and/or modified CDS sequence (wt) from DENV-1__FJ850104__SS-prME
  source 1..9879: mol_type = other RNA
tccgtgaccatgctcctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccggatcactgaggcggaaccagatgacgttgactgctggtgcaatgtcacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgctataggaacatccatcactcagaaagggatcattttcatcttgctgatgctggtgacaccatcaatggctatgcgatgtgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgcggactattcggaaagggaagtctattgacgtgtgccaagttcaagtgtgtgacaaaactagaaggaaagatagttcaatatgaaaacttgaaatattcagtgatagtcactgtccacactggggaccagcaccaggtgggaaacgagaccacagaacatggaacaattgcaaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccatggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagactaaaaatggataaactgactttaaaggggatgtcatatgtgatgtgcacaggctcatttaagctagagaaggaagtggctgagacccagcatggaactgttctagtgcaggtcaaatacgaaggaacagatgcgccatgcaagatccccttttcgacccaagatgagaaaggagtgacccagaatgggagattgataacagccaatcctatagttactgacaaagaaaaaccagtcaacattgagacagaaccaccttttggtgagagctacatcgtggtaggggcaggcgaaaaagctttgaaactaagctggttcaagaaaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgttcagcggtgtttcttggaccatgaaaataggaatagggattctgctgacatggttgggattaaattcaaggagcacgtcactttcgatgacgtgcattgcagttggcatggtcacactgtacctaggagtcatggttcaagcggactcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtgtgtggaattcgatcagccacgcgtcttgagaacatcatgtggaagcaaatatcaaatgaattgaaccacattctacttgaaaatgatatgaaattcacagtggttgtaggagatgctaacggaatcttggcccaagggaaaaaaatgattaggccacaacccatggaacacaaatactcatggaaaagctggggaaaagctaaaatcataggagcagacatacaaaataccaccttcatcatcgacggcccagacaccccagaatgtcccgatggccaaagagcatggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaaccacagaccagggtatttcacacaaacagcagggccatggcacctaggtaagttggaactggattttgacttgtgtgaaggtaccacagttgttgtggatgaacattgtggaaatcgaggtccatctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattgggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttactgtctctgacatttgtcaaaacaactctttcattggattatgcatggaaaacaacggctatggtactgtcaatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactcctcaaaaatgacgtgccgttggccggcccactaatagctggaggcatgctgatagcatgttatgtcatatccggaagctcagccgatttatcattggagaaagcggctgaggtgtcctgggaacaagaagcagaacactccggtgcctcacacaacatactagtagaggtccaagatgatggaactatgaaaataaaagatgaagagagggatgacacactcactatactccttaaagcaactctgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttgggcaggtcccaagtaggagtgggagtcttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggcgaagttggagccatagctctagatttcaaacccggcacatctggatctcccattgtgaacagagagggaaaaatagtgggtctttatggaaacggagtggtgacaacaagtggaacctacgtcagtgccattgcccaagctaaagcatcacaggaagggcctctaccagagattgaggacgaggtgtttaagaaaagaaacttaacaataatggacctgcacccaggatcaggaaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacctttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagtcatccaagatgaggaaagagacattcctgagagatcatggaactcaggctacgactggattactgattttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggatgccagaacatactccgatccactggccctgcgcgagtttaaagagtttgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtctagggaaaacatctattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgctacaatgctggacgtagacctacgcccagcttcagcctggaccctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggcccattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaaggaaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttctaaaaatggtggaaccatggctcagaggaaatcaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggaagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaattaggagaatttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgaccagagaggaagtggacaggtcggaacttatggcttaaatactttcaccaatatggaggtccaactaataagacaaatggagtctgaaggaatcttcttacccagcgaattggaaacccccaacctagctgagagagttcttgactggttggaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccacagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcctgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggtttgacagcgagggccacctgggccaccaacatacaagtagccataaaccaagtgagaaggctcatcgggaatgagaattatctagattacatgacatcaatgaagagattcaagaatgagagtgatcccgaaggagcactctggtaa

SEQ ID NO: 5629 - RNA, 9879 nt, synthetic construct
  misc_feature 1..9879: note = derived and/or modified CDS sequence (wt) from DENV-1__JN819405__SS-prME
  source 1..9879: mol_type = other RNA
tccgtgaccatgctcctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccggattactgaggcggaaccagatgacgttgactgctggtgcaacgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacctgggctttgagacacccaggattcacggtgatagccctttttttagcacatgctataggaacatccatcactcagaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacaaatcctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaacggctgcggactattcggaaagggaagtctattgacgtgtgccaagttcaagtgtgtgacaaaactagaaggaaagatagttcaatatgagaacttaaaatattcagtgatagttaccgtccacactggggaccagcatcaggtggggaacgagaccacagaacatggaacaattgcaaccataacacctcaagctcctacgtcggaaatacagctgaccgactacggagcccttacattggactgctcacctagaacagggctggactttaatgagatggtgctattgacaatgaaagaaaaatcatggcttgtccacaaacaatggtttctagacttaccactgccatggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagactaaaaatggacaaactgactttaaaggggatgtcatatgtgatgtgcacaggctcattcaagctagagaaggaagtggctgagacccagcatggaactgttctagtgcaggtcaaatacgaaggaacagacgcgccatgcaagatccccttctcgactcaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagaaaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgttcagcggtgtttcttggaccatgaaaataggaatagggattctgttgacatggttgggattaaattcaaggagcacgtcactttcgatgacgtgcattgcagttggcatggtcacactgtacctaggagtcatggttcaagcggactcgggatgtgtgatcaactggaagggcagagaacttaaatgtggaagtggcatttttgtcactaatgaagtccacacttggacagagcaatacaaattccaggctgactccccaaaaagactgtcagcagccattggaaaggcatgggaggagggagtgtgtggaattcgatcagccacgcgtcttgagaacattatgtggaagcaaatatcaaatgaattgaaccacattctacttgaaaatgatatgaaattcacagtggttgtaggagatgctaacggaattttggcccaagggaaaaaaatgattaggccacaacccatggaacacaaatactcatggaaaagctggggaaaagctaaaatcataggagcagacatacaaaataccacctttatcatcgacggcccagacaccccagaatgtcccgatggccaaagagcatggaacatttgggaagttgaggactatgggtttggaattttcacgacaaacatatggctgaaattgcgtgactcctacacccaaatgtgtgaccaccggctaatgtcagctgccatcaaggacagcaaggcagttcatgctgacatggggtactggatagaaagtgaaaagaacgaaacctggaagctggcgagagcctccttcatagaagtcaagacatgcacctggccaaaatctcacactctatggagcaatggagttttggaaagtgaaatgataatcccaaagatatatggaggaccaatatctcagcacaactacaggccagggtatttcacacaaacagcagggccatggcacctaggtaagttggaactggattttgacttgtgtgaaggcaccacagttgttgtggatgaacattgtggaaatcgaggtccatctcttagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgcacctagccttgatggctactttcaaaatgagaccaatgttcgctgttgggctattattccgcagattaacatccagagaagttcttctcctcacgattggattaagcctgatggcatccatggagctaccaaattctttggaggagctaggggatggacttgcaatgggtatcatgatgttaaaattgttgactgaatttcagccacaccagttatggaccaccttactgtctttgacatttgtcaaaacaactctctcattggattatgcatggaaaacaacggctatgatactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactcctaaaaaatgatgtgccattggccggcccactaatagctggaggcatgctaatagcatgttatgtcatatccggaagctcagccgatttatcattggagaaagcggctgaggtgtcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttgggcaggtcccaagtaggagtgggagtcttccaagacggcgtgttccacacaatgtggcacgtcaccaggggagctgtccttatgtaccaagggaagaggctggaaccaagctgggccagtgtcaaaaaggacttgatctcatatggaggaggttggagatttcaaggatcatggaacacgggagaagaagtgcaggtgatagctgttgaaccaggaaaaaaccccaaaaatgtacagacaacgccgggtaccttcaagactcctgaaggcgaagttggagccatagctctagatttcaaacccggcacatctggatctcccattgtgaacagagagggaaaaatagtgggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcaggaaaaacaagaagatatcttccagccatagtccgtgaggccataaaaaggaaactgcgtacgttaatcttggctcccacaagagttgttgcctctgaaatggcagaggcactcaagggaatgccaataagatatcagacaacagcagtgaagagtgaaaccacaggaagggagatagttgacctcatgtgccacgctacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcaccgactttccaggtaaaacagtctggtttgttccaagcattaaatcaggaaatgacattgccaactgtttaagaaagaacggaaaacgggtaatccaactgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagagaagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcggcctcgctggttggatgccagaacatactctgatccactggctctgcgcgagtttaaagagtttgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacacgctatggaggaactaccagacaccatagaaacattgatgcttctagctttgatagctgtgttgactggtggagtgacgctattcttcctatcaggaaaaggtttagggaaaacatctattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacacgctacaatgctggacgtagacctacgcccagcttcagcctggaccctctatgcagtagccacaacagttatcactcccatgatgagacatacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttagatcctgtggtttatgatgcaaaatttgaaaaacagctaggccaaataatgttactgatactttgtacatcacagatcctcttgatgcggaccacatgggccttgtgtgaatccattacactggctactggacccctgaccactctctgggagggatctccaggaaaattctggaataccacgatagcagtgtccatggcaaacatcttcaggggaagttatctagcaggagcaggtctggctttttcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaaggaaaagtcatagacctcggttgtggaagaggtggctggtcatactattgtgctgggctgaagaactttactgaagtgaagggatacacaagcggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttctaaaaatggtggaaccatggctcaaaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacaaattatggaggtgacagccaagtggttatggggtttcctttccagaaacaaaaagcccagaatctgcacaagagaggagttcacaagaaaagttaggtcaaacgcggcaataggagcagtgttcgttgatgaaaaccaatggaactcggcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccagggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgaccagagaggaagtggacaggtcggaacttatggcttaaatactttcaccaatatggaggtccaactaataagacaaatggagtctgaaggaatctttttacccagcgaattggaaactcccaacctagctgagagagttcttgactggttggaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggagccttcaaaaggatggaatgattggcagcaagtgcctttctgttcacaccatttccaccagctgatcatgaaggatgggagggaaatagtggtgccatgccgcaatcaagatgaacttgtgggcagggccagagtatcgcaaggcgccggatggagcctgagagaaactgcttgcctaggcaagtcatatgcacaaatgtggcagctgatgtacttccacaggagagacctgagactagcggctaacgccatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcctgaaggagcactctggtaa

SEQ ID NO: 5630 - RNA, 9879 nt, synthetic construct
  misc_feature 1..9879: note = derived and/or modified CDS sequence (wt) from DENV-1__GQ199877__SS-prME
  source 1..9879: mol_type = other RNA
tccgtgaccatgctcctcatgctgctgcccacagccctggcgtttcatttgaccacacgagggggagagccacacatgatagttagtaagcaggaaagaggaaagtcactcttgtttaagacctctgcgggcgtcaatatgtgcaccctcattgcgatggacttgggagagttatgtgaggacacaatgacctacaaatgcccccggatcactgaggcggaaccagatgacgttgactgctggtgtaatgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggaaacaaatacaaagagtggaaacttgggctttgagacacccaggattcacggtgatagccttttttttagcacatgctataggaacatccatcactcaaaaagggatcattttcatcttgctgatgctggtgacaccatcaatggccatgcgatgtgtgggaataggcaacagagacttcgttgaaggactgtcaggagcaacgtgggtggacgtggtattggaacatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgcggactattcggaaagggaagtctattgacgtgtgccaagttcaagtgtgtgacaaaactagaaggaaagatagttcaatatgaaaacttaaaatattcagtgatagtcactgtccacactggggaccagcaccaggtgggaaacgagaccacagaacatggaacaattgcaaccataacacctcaagctcccacgtcggaaatacagctgaccgactacggagccctcacattggactgctcacctagaacagggctggactttaatgagatggtgctattgacaatgaaagaaaaatcatggcttgtccacaaacaatggtttctagacttaccactgccatggacttcgggggcttcaacatctcaagagacctggaacagacaagatttgctggtcacattcaagacagctcatgcaaagaaacaggaagtagtcgtactgggatcacaggaaggagcaatgcacacagcgttgactggggcgacagaaatccagacgtcaggaacgacaacaatctttgcaggacacctgaaatgcagactaaaaatggataaactgaccttaaaggggatgtcatatgtgatgtgcacaggctcatttaagctagagaaggaagtggctgagacccagcatggaactgttctagtgcaggtcaaatatgaaggaacagacgcgccatgcaagatccccttttcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagtagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgtttagcggtgtttcttggaccatgaaaataggaatagggatcctgctgacatggttgggattaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtgtgtggaattcgatcagccacgcgtcttgagaacatcatgtggaagcaaatatcaaatgaattgaaccacattctacttgagaatgacatgaaattcacagtggttgtaggagatgccaacggaattttggcccaagggaaaaaaatgattaggccacaacctatggaacacaaatactcatggaaaagctggggaaaagctaaaatcataggagcagacatacaaaatactaccttcatcatcgacggcccagacaccccagaatgtcccgatggccaaagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacagcagggccatggcacctaggtaagttggaactggattttgacttgtgtgaaggtaccacagttgttgtggatgaacattgtggaaatcgaggtccatctctcagaaccacaacagtcacaggaaagataatccatgaatggtgttgcagatcctgcacgctaccccccttacgtttcagaggagaagacgggtgttggtatggcatggaaatcagaccagtaaaggagaaggaggagaatctagtcaggtcaatggtctctgcagggtcaggagaagtggatagtttttcattaggaatactatgcgtgtcaataatgattgaagaagtgatgagatccagatggagtagaaagatgctgatgactggaacattggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagactaacatccagagaagttcttctcctcacgattggattaagcctggtggcatccgtggagctaccaagttctttggaggagctaggggatggacttgcaatgggtatcatgatgttaaaattgttgactgaatttcagccacaccagttatggaccaccttgttgtctctgacatttgtcaaaacaactctctcactggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagctcactcctcaaaaatgatgtgccgttggccgggccactaatagctggaggcatgctaatagcatgttatgtcatatccggaagctcagccgatttatcattggagaaagcggctgaagtatcctgggaacaagaagcagaacactccggtgcctcacacaacatattagtagaggtccaagatgatggaactatgaaaataaaagatgaagagagggatgacacactcactatactccttaaagcaacattgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttggggaggtcccaagtaggagtaggagtcttccaagacggcgtgttccacacaatgtggcacgttaccaggggagctgtccttatgtaccaagggaagagactggaaccaagctgggccagtgtcaaaaaggacttgatctcatatggagggggttggaggttccaaggatcatggaacacaggagaagaagtgcaggtgatagctgttgaaccaggaaaaaaccccaaaaatgtgcagacaacgccgggcaccttcaagactcctgaaggcgaagttggagccatagctctagatttcaaacccggcacatctggatctcccattgtgaacagagagggaaaaatagtgggtctgtatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcagggaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgactttccaggcaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctttttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtattggaggagaacatggacgtggagatctggacaaaggaaggagaaagaaagaaattgcgacctcgctggttggacgccagaacatactctgatccattagccctgcgcgagtttaaagagttcgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgctacaatgctggacgtagacctacacccagcttcagcctggaccctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaagagtgggattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagttactgaagtgaagggatacacaaaaggaggacctggacatgaggaacctatcccaatggcgacctacggatggaacctagtaaagctacactctggaaaggatgtattttttatgccacctgagaaatgtgacacccttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatctagaatgttactgaaccgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacagattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaattaggagagtttggaaaagcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatacttagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgtcatatccagacgtgatcagagaggaagtggacaggtcggaacttatggcttaaatactttcaccaatatggaggtccaactaataagacaaatggagtctgaaggaatctttttacccagcgaattggaaacccccaacctagctgagagggctcttgactggctagaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcaaaaggatggaatgattggcagcaagtgcctttttgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccatcaatggatgacaacagaagacatgttatcagtgtggaatagggtttggatagaggaaaacccatggatggaggacaaaactcatgtatccagttgggaagaagttccatacctaggaaaaagggaagaccaatggtgtggatccctgataggcttgacagcgagggccacctgggccaccaacatacaagtagccataaaccaagtgagaaggctcatcgggaatgagaattatttagattacatgacatcaatgaagagattcaagaatgagagtgatcccgaaggagcactctggtaa

SEQ ID NO: 5631 - RNA, 9879 nt, synthetic construct
  misc_feature 1..9879: note = derived and/or modified CDS sequence (wt) from DENV-1__GU056029__SS-prME
  source 1..9879: mol_type = other RNA
tccgtgaccatgctcctcatgctgctgcccacagccctggcgtttcatttgaccacacgagggggagagccacacatgatagttagtaagcaggaaagaggaaagtcactcttgtttaagacctctgcgggcgtcaatatgtgcaccctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggaaacaaatacaaagagtggaaacttgggctttgagacacccaggattcacggtgatagctttttttttagcacatgctataggaacatccatcactcagaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacaaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgcggactattcggaaagggaagtctattgacgtgtgccaagttcaagtgtgtgacaaaactagagggaaagatagttcaatatgaaaacctaaaatattcagtgatagtcactgtccacactggggaccagcaccaggtgggaaacgagaccacagaacatggaacaattgcaaccataacacctcaagctcccacgtcggaaatacagctgaccgactacggagccctcacattggactgctcacctagaacagggctggactttaatgagatggtgctattgacaatgaaagaaaaatcatggcttgtccacaaacaatggtttctagacttaccactgccatggacttcgggggcttcaacatctcaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagactaaaaatggataaactgaccttaaaggggatgtcatatgtgatgtgcacaggctcatttaagctagagaaggaagtggctgagacccagcatggaactgttctagtgcaggtcaaatatgaaggaacagacgcgccatgcaagatccccttttcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgtttagcggtgtttcttggaccatgaaaataggaatagggattctgctgacatggttgggactaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtgtgtggaattcgatcagccacgcgtcttgagaacatcatgtggaagcaaatatcaaatgaattgaaccacattctacttgagaatgacatgaaattcacagtggttgtaggagatgccaacggaattttggtccagggaaaaaaaatgattaggccacaacccatggaacacaaatactcatggaaaagctggggaaaagctaaaatcataggagcagacatacaaaataccaccttcatcatcgacggcccagacaccccagaatgtcccgatggccaaagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacagcagggccatggcacctaggtaagttggaattggattttgacttgtgtgaaggtaccacagttgttgtggatgaacattgtggaaatcgaggtccatctctcagaaccacaacagtcacaggaaagataatccatgaatggtgttgcagatcctgcacgctaccccccttacgtttcagaggagaagacgggtgttggtatggcatggaaatcagaccagtaaaggagaaggaggagaatctagttaggtcaatggtttctgcagggtcaggagaagtggatagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttattgtctctgacatttgtcaaaacagctctctcattggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagctggcccctcaatgaaggaattatggctattggaatagtcagcattctactaagctcactcctcaaaaatgatgtgccgttggccgggccactaatagctggaggcatgctaatagcatgttatgtcatatccggaagctcagccgatttatcattggagaaagcggctgaagtatcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgacaatggcatctatagaatcttgcaaagaggactgttgggcaggtcccaagtaggagtgggagtcttccaagacggcgtgttccacacaatgtggcacgttaccaggggagctgtccttatgtaccaagggaagagactggaaccaagctgggccagtgtcaaaaaggacttgatctcatatggaggaggttggaggttccaaggatcatggaacacgggagaagaagtgcaggtgatagctgttgaaccaggaaaaaaccccaaaaatgtacagacaacgccgggcaccttcaagactcctgaaggcgaagttggagccatagctctagatttcaaacccggcacatctggatctcccattgtgaacagagagggaaaaatagtgggtctgtatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcagggaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgaccagtatgtttatatgggacagcctttaaataatgatgaggatcacgctcattggacagaagcaaaaatgctccttgacaatataaacacaccagaagggatcatcccagccctttttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggacgccagaacatactctgatccattggccctgcgcgagtttaaagagttcgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggcctagggaaaacatccattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgctacaatgctggacgtagacctacacccagcttcagcctggaccctctatgcagtagccacaacagttatcactcccatgatgagacacacaattgaaaatacaacggcaaacatttccctgaccgccattgcaaatcaggcagctatattgatgggacttgacaagggatggccaatatcgaagatggacataggagttccacttctcgccttagggtgctattcccaggtgaacccattgacactgacagcggcggtgttgatgttagtagctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaaggaaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaagctacactctggaaaggatgtattttttatgccacctgagaaatgtgacacccttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcataggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacagattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagaccactggtttagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgatcagagaggaagtggacaggtcggaacttatggcttaaatactttcaccaatatggaggtccaactaataagacaaatggagtctgaaggaatctttctacccagcgaattggaaacccccaacctagctgagagggctcttgactggttagaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcaaaaggatggaatgattggcagcaagtgcctttttgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctaggaaaaagggaagatcaatggtgtggatccctgataggcttgacagcgagggccacctgggccaccaacatacaagtagccataaaccaagtgagaaggctcatcgggaatgagaattatttagattacatgacatcaatgaagagattcaagaatgagagtgattccgaaggagcactctggtaa

SEQ ID NO: 5632 - RNA, 9879 nt, synthetic construct
  misc_feature 1..9879: note = derived and/or modified CDS sequence (wt) from DENV-1__GU056030__SS-prME
  source 1..9879: mol_type = other RNA
tccgtgaccatgctcctcatgctgctgcccacagccctggcgttccatttgaccacacgagggggagagccacacatgatagttagtaagcaggaaagaggaaagtcactcttgtttaagacttctgcaggtgtcaatatgtgcactctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccttttttttagcacatgctataggaacatccatcactcagaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgcggactattcggaaagggaagtctattgacgtgtgccaagttcaagtgtgtgacaaaactagaaggaaagatagttcaatatgaaaacttaaaatactcagtgatagtcactgtccacactggggaccagcaccaggtgggaaacgagaccacagaacatggaacaattgcaaccataacaccacaagctcctacgtcggaaatacagctgaccgactacggagccctcacattggactgctcacctagaacagggctggactttaatgagatggtgctattgacaatgaaagaaaaatcatggcttgtccacaaacaatggtttctagatttaccactgccatggacttcgggggcttcaacatctcaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagactaaaaatggataaactgaccttaaaggggatgtcatatgtgatgtgcacaggctcatttaagctagagaaggaagtggctgagacccagcatggaactgttctagtgcaggtcagatacgaaggaacagacgcgccatgcaagatccccttttcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatctgtgggaaagttggtacaccaggtttttggaaccgcatatggggttctgttcagcggtgtttcttggaccatgaaaataggaatagggattctgctgacatggttgggattaaattcaaggagcacgtcactttcgatgacgtgcattgcagttggcatggtcacactgtacctaggagtcatggttcaagcagactcgggatgtgtaatcaactggaagggcagagaacttaaatgtggaagtggcatttttgtcactaacgaagttcacacttggacagagcaatacaaattccaggctgactccccaaaaagactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaacggaattttggcccaagggaaaaaaatgattaggccacaacccatggaacacaaatactcatggaaaagctggggaaaagctaaaatcataggagcagacatacaaaataccaccttcatcatcgacggcccagacaccccagaatgtcccgatggccaaagagcatggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacttggccgaaatctcacactctatggagcaatggagttttggaaagtgaaatgataatcccaaagatatatggaggaccaatatctcagcacaactacagaccagggtattacacacaaacagcagggccatggcacctaggtaagttggaactggattttgacttgtgtgaaggtaccacagttgttgtggatgaacattgtggaaatcgaggtccatctctcagaaccacaacagtcacaggaaagataatccatgaatggtgttgcagatcctgcacgctaccccccttacgtttcagaggagaagacggatgttggtatggcatggaaatcagaccagtaaaggagaaggaggagaatctagttaggtcaatggtctctgcagggtcaggagaagtggacaatttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagccaatgcttcagacgggatggggatgggaacaacgtacctagccttgatggctactttcaaaatgagaccaatgttcgctgttgggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttactgtctctgacatttgtcaaaacaactctctcattggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactcctcaaaaatgatgtgccgttggccggcccactaatagctggaggcatgctaatagcatgttatgtcatatccggaagctcagctgatttatcattggacaaagcggctgaagtatcctgggaacaagaagcagaacactccggtgcctcacacaacatatcagtagaggtccaagatgatggaactatgaaaataaaagatgaagagagggatgacacactcaccatactccttaaagcaactttgctggcagtttcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttgggcaggtcccaagtaggagtgggagtcttccaagacggcgtgttccacacaatgtggcacgtcaccaggggagctgtccttatgtaccaagggaagaggctggaaccaagctgggcctgtgtcaaaaaggacttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggcgaagttggagccatagctctagatttcaaacccggcacatctggatctcccattgtgaacagagagggaaaaatagtgggtctttatggaaatggagtggtgacaacaagcggaacctacgtcagtgccattgcccaagctaaagcatcacaggaagggcctctaccagagattgaggacgaggtgtttaagaaaagaaacttaacaataatggacctgcacccaggatcagggaaaacaagaagatatcttccagccatagtccgtgaggccataaaaaggaaactgcgtacgttaatcctggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgattttccaggcaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttatatgggacagcctttaaataatgatgaggatcacgctcattggacagaagcaaaaatgctccttgacaatataaacacaccagaagggatcatcccagccctttttgagccagagagagaaaagagtgcagcaatagatggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggatgccagaacatactctgatccactggccctgcgcgagtttaaagagtttgcagcaggaagaagaagtgtctcaggtgacctaatactggaaatagggaaacttccacaacatttgacgctaagagcccagaatgccctggacaacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtttagggaaaacatccattggcttgctctgtgtgacggcctcaagtgcactgttatggatggccagtgtggagccccattggatagcggcctccatcatactagagttctttttgatggtgctgctcattccagagccagacagacagcgcactccacaggacaaccagctagcatatgtggtgataggcttgttattcatgatacttacagtggcagccaatgagatgggattattggaaaccacaaagaaagacctggggattggctatgtagccgccgaaaaccaccaacatgctacaatgctggacgtagacctacacccagcttcagcctggaccctctatgcagtagccacaacagttatcactcccatgatgagacacacaattgaaaacacaacggcaaacatttccctgacagccattgcaaatcaggcagctatattgatgggacttgacaagggatggccaatatcgaagatggacataggagttccacttctcgccttagggtgctattcccaggtgaacccattgacgctgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtctatgatgtaaaatttgaaaaacagctaggccaaataatgttactgatactttgtacatcacagatcctcttgatgcggaccacatgggccttgtgtgaatccatcacactggctactggacccctgactactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaaccaatcatgcagtgtcgagaggaacagccaaactgaggtggtttgtggagaggaacctcgtgaaaccagaaggaaaagtcatagacctcggttgtggaagaggtggctggtcatattattgtgctgggctgaagaaagttactgaagtgaagggatacacaaaaggaggacctggacatgaggagcctatcccaatggcgacctatggatggaacctagtaaagctacactctggaaaagatgtatttttcatgccacctgagaaatgtgacacccttctgtgtgatattggtgagtcctctccgaatccaaccatagaagaaggaagaacgttacgtgttctaaaaatggtggaaccatggctcagaggaaaccaattctgcataaaaatcttaaatccttacatgccaagtgtggtagaaactcttgagcaaatgcaaagaaaacatggagggatgctagtgcgaaacccactctcaagaaattctacccatgaaatgtattgggtttcatgtggaacaggaaacattgtgtcggcagtgaacatgacatccagaatgctactgaaccgattcacaatggctcacaggaagccaacatatgaaagagatgtggacttaggcgctggaacaagacatgtgacagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgtacaccaagagcaaaacgaggcacaacacaaattatggaggtgacagccaagtggttatggggtttcctttccagaaacaaaaaacccagaatctgcacaagagaggagttcacaagaaaggtcaggtcaaacgcggcaataggagcagtgttcgttgacgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttttggagttcgaagcccttggtttcatgaatgaagatcactggtttagtagagagaattcactcagtggagtggaaggagaaggactgcacaaactcggatacatactcagagacatatcaaagattccggggggaaacatgtatgcagatgatacagccggatgggacacaagaataacagaggatgatctccagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgaccagagaggaagtggacaggtcggaacttatggcttaaatactttcaccaatatggaggtccaactaataagacaaatggagtctgaaggaatctttttacccagcgaattggaaacccccaacctagctgagagagttcttgactggttagaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagatctgagactagcagctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcccgaaggagcactctggtaa

SEQ ID NO: 5633 - RNA, 9879 nt, synthetic construct
  misc_feature 1..9879: note = derived and/or modified CDS sequence (wt) from DENV-1__GU056031__SS-prME
  source 1..9879: mol_type = other RNA
tccgtgaccatgctcctcatgctgctgcccacagccctggcgtttcatttgaccacacgagggggagagccacacatgatagttagtaagcaggaaagaggaaagtcactcttgtttaagacctctgcgggcgtcaatatgtgcaccctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagagaaacgttccgtggcactggccccacacgtgggacttggcctagaaacaagaaccgaaacatggatgtcctctgaaggcgcctggaaacaaatacaaagagtggaaacttgggctttgagacacccaggattcacggtgatagccttttttttagcacatgctataggaacatccatcactcaaaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgcggactattcggaaagggaagtctattgacgtgtgccaagttcaagtgtgtgacaaaactagaaggaaagatagttcaatatgaaaacttaaaatattcagtgatagtcactgtccacactggggaccagcaccaggtgggaaacgagaccacagaacatggaacaattgcaaccataacacctcaagctcccacgtcggaaatacagctgaccgactacggagccctcacattggactgctcacctagaacagggctggactttaatgagatggtgctattgacaatgaaagaaaaatcatggcttgtccacaaacaatggtttctagacttaccactgccatggacttcgggggcttcaacatctcaagagacctggaacagacaagatttgctggtcacattcaagacagctcatgcaaagaaacaggaagtagtcgtactgggatcacaggaaggagcaatgcacacagcgttgactggggcgacagaaatccagacgtcaggaacgacaacaatcttcgcaggacacctgaaatgcagactaaaaatggataaactgaccttaaaggggatgtcatatgtgatgtgcacaggctcatttaagctagagaaggaagtggctgagacccagcatggaactgttctagtgcaggtcaaatatgaaggaacagacgcgccatgcaagatccccttttcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgtttagcggtgtttcttggaccatgaaaataggaatagggattctgctgacatggttgggattaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtgtgtggaattcgatcagccacgcgtcttgagaacatcatgtggaagcaaatatcaaatgaattgaaccacattctacttgagaatgacatgaaattcacagtggttgtaggagatgccaacggaattttggcccaagggaaaaaaatgattaggccacaacccatggaacacaaatactcatggaaaagctggggaaaagctaaaatcataggagcagacatacaaaatactaccttcatcatcgacggcccagacaccccagaatgtcccgatggccaaagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacagcagggccatggcacctaggtaagttggaactggattttaacttgtgtgaaggtaccacagttgttgtggatgaacattgtggaaatcgaggtccatctctcagaaccacaacagtcacaggaaagataatccatgaatggtgttgcagatcctgcacgctaccccccttacgtttcagaggagaagacgggtgttggtatggcatggaaatcagaccagtaaaggagaaggaggagaatctagtcaggtcaatggtctctgcagggtcaggagaagtggatagtttttcattaggaatactatgcgtgtcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttattgtctctgacatttgtcaaaacaactctctcactggattatgcatggaaaacaacggctatggtactgtctatcgtatctctctttcctttatgcctgtctacgacctcccaaaaaacaacatggcttccggtgctgttaggatcttttggatgcaaaccatcaaccatgtttcttataacagaaaacaaaatctggggaaggaaaagttggcccctcaatgaaggaattatggctattggaatagtcagcattctactaagctcactcctcaaaaatgatgtgccgttggccgggccactaatagctggaggcatgctaatagcatgttatgtcatatccggaagctcagccgatttatcattggagaaagcggctgaagtatcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttggggaggtcccaagtaggagtgggagtcttccaagacggcgtgttccacacaatgtggcacgttaccaggggagctgtccttatgtaccaagggaagagactggaaccaagctgggccagtgtcaaaaaggacttgatctcatatggaggaggttggaggttccaaggatcatggaacacaggagaagaagtgcaggtgatagctgttgaaccaggaaaaaaccccaaaaatgtacagacaacgccgggcaccttcaagactcctgaaggcgaagttggagccatagctctagatttcaaacccggcacatctggatctcccattgtgaacagagagggaaaaatagtgggtctgtatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcagggaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctttttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggacgccagaacatactctgatccattggccctgcgcgagtttaaagagttcgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgctacaatgctggacgtagacctacacccagcttcagcctggaccctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaagctacactctggaaaggatgtattttttatgccacctgagaaatgtgacacccttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatctagaatgttactgaaccgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacagattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatacttagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgatcagagaggaagtggacaggtcggaacttatggcttaaatactttcaccaatatggaggtccaactaataagacaaatggagtctgaaggaatctttttacccagcgaattggaaacccccaacctagctgagagggctcttgactggttagaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcaaaaggatggaatgattggcagcaagtgcctttttgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctaggaaaaagggaagaccaatggtgtggatccctgataggcttgacagcgagggccacctgggccaccaacatacaagtagccataaaccaagtgagaaggctcatcgggaatgagaattattcagattacatgacatcaatgaagagattcaagaatgagagtgatcccgaaggagcactctggtaa

SEQ ID NO: 5634 - RNA, 9879 nt, synthetic construct
  misc_feature 1..9879: note = derived and/or modified CDS sequence (wt) from DENV-1__GU056032__SS-prME
  source 1..9879: mol_type = other RNA
tccgtggccatgctcctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggaaacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgtgtcaccaccatggcaaaaaataaaccaaccttggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgcggactattcggaaagggaagcctattgacgtgtgccaagttcaagtgtgtgacaaaattagaaggaaagatagttcaatatgaaaacttaaaatattcagtgatagtcactgtccacactggggaccagcaccaggtgggaaacgagactacagaacatggaacaattgcaaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctagtcacatttaagacagctcatgcaaagaaacaggaagtagtcgtactgggatcacaggaaggagcaatgcatactgcgttgactggggcgacagaaatccagacgtcaggaacgacaacaatctttgcaggacacctgaaatgcagactaaaaatggataaactgactttaaaggggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagttactgacaaagaaaaaccagtcaacattgagacagaaccaccttttggtgagagctacatcgtggtaggggcaggtgaaaaagctttgaaactaagctggttcaagaaaggaagcagcatagggaaaatgttcgaagcaaccgcccgaggagcacgaaggatggctattctgggagacaccgcatgggacttcggctctataggaggagtgttcacatctgtgggaaaattggtacaccaggtttttggaaccgcatatggggttctgttcagcggtgtttcttggaccatgaaaataggaatagggattctgctgacatggttgggattaaattcaaggagcacgtcactttcgatgacgtgcattgcagttggcatggttacgctatacctaggagtcatggttcaagcggactcgggatgtgtaatcaactggaagggcagagaactcaaatgtggaagtggcatttttgtcactaatgaagtccacacttggacagagcaatacaaattccaggctgactccccaaaaagactgtcagcagccattggaaaagcatgggaggagggcgtgtgtggaattcgatcagccacgcgccttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaatcataggagcagacatacaaaataccaccttcatcatcgacggcccagataccccagaatgccccgatgaccaaagagcgtggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacagcagggccatggcacctaggcaagttggaattggattttgacttgtgtgaaggtaccacagtcgttgtggatgaacattgtggaaatcgaggtccttctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatttagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttctcctcacgattggattaagcttggtggcatccgtggagctaccaaattctttggaggagctaggggatggacttgcaatgggtatcatgatgttaaaattattgactgaatttcagccacaccagttatggaccaccttactgtctctgacatttatcaaaacaactctttcattggattatgcatggaaaacaacggctatggtactgtcaatcgtatctctctttcctttatgcctgtctacgacctcccaaaaaacaacatggcttccggtgctgttaggatcttttggatgcaaaccgttaaccatgtttcttataacagaaaacaaaatctggggaaggaaaagttggcccctcaatgaaggaattatggctgttggaatagtcagcatgctactaagttcactcctcaaaaatgatgtgccgctggccggcccactaatagctggaggcatgctaatagcatgttatgtcatatccggaagctcagccgatttatcattggagaaagcggctgaggtgtcctgggaacaagaggcagaacactccggtacctcacacaacatactagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggcgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgcacgttaatcttggcccccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgattattatggatgaagcacatttcaccgatccagccagcatagcggccagagggtacatctcaacccgagtgggtatgggtgaagcagctgcgatctttatgacagccactcccccaggatcggtggaagcctttccacagagtaatgcagtcattcaagatgaggaaagagacattcctgagagatcatggaactcaggctacgactggatcactgattttccaggtaaaacagtctggtttgtcccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctgtcctacaaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccactggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgccatggaggaactaccagacaccatagaaacattgatgcttctagctttgatagctgtgttgactggtggagtgacgctgttcttcctatcaggaaaaggtctagggaaaacatccatcggcctgctctgtgtgacggcctcaagcgcactgttatggatggccagtgtggagccccattggatagcggcctccatcatactagagttctttttgatggtgctgcttattccagagccagacagacagcgcactccacaggacaaccagctagcatatgtggtgataggtttgttattcatgatactgacagtggcagccaatgagatgggattattggaaaccacaaagaaagacctggggattggccatgtagcggccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtggaattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttttaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaacataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagccatgaccgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagccgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgcaacagccttaacagccctgaatgacatgggaaaaataagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcttgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccactaacatacaagtggccataaaccaagtgagaaggctcatcgggaatgagaattatctagattacatgacatcaatgaagagattcaagaatgagagtgataccgaaggggcactctggtaa

SEQ ID NO: 5635 - RNA, 9879 nt, synthetic construct
  misc_feature 1..9879: note = derived and/or modified CDS sequence (wt) from DENV-1__GU056033__SS-prME
  source 1..9879: mol_type = other RNA
tccgtgaccatgctcctcatgctactgcccacagccctggcgttccatttgaccacacgagggggagagccacacatgatagttagtaagcaggagagaggaaagtcactcttgtttaagacctctgtaggtgtcaacatgtgcactctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgtgtgggaataggcaacagagacttcgttgaaggactgtcaggagcaacgtgggtggacgtggtattggagcatggaagctgcgtcaccaccatggcaaaaaataaaccaacattggacattgaactcttaaagacggaggtcacgaaccctgccgtcttgcgcaaactgtgcattgaagccaaaatatcaaacaccaccaccgattcaagatgtccaacacaaggagaggctacactggtggaagaacaagacgcgaactttgtgtgtcgccgaacgttcgtggacagaggctggggtaatggctgcggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcaaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacatttaagacagctcatgcaaagaaacaggaagtagtcgtactgggatcacaggaaggagcaatgcacactgcgttgactggggcgacagaaatccagacgtcaggaacgacaacaatctttgcaggacacctgaaatgcagactaaaaatggataaactgactttaaagggaatgtcatatgtgatgtgcacaggctcattcaagctagagaaggaagtggctgagacccagcatggaactgttttagtgcaggtcaaatacgaaggaacagacgcgccatgcaagatccccttttcgacccaagatgagaaaggagtgacccagaatgggagattgataacagccaatcccatagttactgacaaagaaaaaccagtcaacattgagacagaaccaccttttggtgagagctacatcgtggtaggggcaggtgaaaaagctttgaaactaagctggttcaagaaaggaagcagcatagggaaaatgttcgaagcaaccgcccgaggagcacgaaggatggctatcctgggagacaccgcatgggacttcggctctataggaggagtgttcacatctgtgggaaaattggtacaccaggtttttggaaccgcatatggggttctgttcagcggtgtttcttggaccatgaaaataggaatagggattctgctgacatggttgggattaaattcaaggagcacgtcactttcgatgacgtgcattgcagttggcatggttacactgtacctaggagtcatggttcaagcggactcgggatgtgtaatcaactggaagggcagagaactcaaatgtggaagtggcatttttgtcactaatgaagtccatacttggacagagcaatacaagttccaggctgactctccaaaaagactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgttaatggaattttggcccaaggaaaaaaaatgattaggccacagcccatggaacacaaatactcatggaaaagctggggaaaagctaaaatcataggagcagacatacaaaataccaccttcatcatcgacggcccagataccccagaatgccccgatgaccaaagagcgtggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgaaagcctccttcatagaagtcaagacatgcatctggccgaaatcccacactctatggagcaatggagttttggaaagtgaaatgataattccaaagatatatggaggaccaatatctcagcacaactacagaccagggtatttcacacaaacagcagggccatggcacctaggcaagttggaattggattttgacttgtgtgaaggtaccacagttgttgtggatgaacattgtggaaatcgaggtccatctctcagaactacaacagtcacaggaaagataatccatgaatggtgttgcagatcctgcacgttaccccccttacgcttcagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttctcataatgggacaactgacatggaatgatctgattaggttatgcattatggttggagctaatgcttcagacaggatggggatgggaacaacgtacctagccttgatggccactttcaaaatgagaccaatgtttgctgttgggctattatttcgcagactaacatccagagaagttcttcttctcacgattggattaagcctggtggcatccgtggagctaccaaattctttggaggagctaggggatggacttgcaatgggtatcatgatgttaaaattattgactgaatttcagccacaccagttatggaccaccttactgtctctgacatttatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccactaaccatgtttcttataacagaaaacaaaatttggggaaggaaaagttggcccctcaatgaaggaattatggctattggaatagtcagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaagcagaacactccggtacctcacacaacatattagtagaggtccaagatgacggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatctcgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggacttgatctcatacggaggaggttggaggtttcaaggatcatggaacacgggagaagaagtgcaggtaatagctgttgaaccaggaaaaaaccccaaaaatgtacagacaacgccgggtaccttcaagactcctgaaggtgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttgacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaatatgattattatggatgaagcacatttcaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagctggaccgatgccagtgactgtggccagtgctgcccagaggagaggaagaattggaaggaaccaaaacaaggaaggtgatcagtatgtctacatgggacagcctttaaataatgatgaggatcacgctcactggacagaagcaaaaatgctccttgacaatataaacacaccagaagggatcatcccagccctctttgagccagagagagaaaagagtgcagcaatagacggggagtacagactgcgaggagaagcaaggaaaacattcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccactggccctgcgcgagtttaaagagtttgcagcaggaagaagaagtgtctcaggtgacctaatattggaaatagggaaacttccacaacatttgacgctaagagcccagaatgctctggataacttggtcatgttgcacaactccgaacaaggaggaaaagcctatagacatgctatggaggaactaccagacactatagaaacattgatgcttctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttctttctgatggtgctgctcattccagagccagacagacagcgcactccacaggacaaccagttagcatatgtggtgataggtttgttattcatgatactgacagtggcagccaatgagatgggattattggaaaccacaaagaaagacctggggattggccatgtagccgccgaaagccaccaacatgctacaatgctggacgtagacctacgtccagcttcagcctggactctttatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacattgacagcggcggtgttgatgttagtggctcattatgccataattggaccaggactgcaagcaaaggccactagagaagctcaaaaaaggacagcggccggaataatgaaaaatccaaccgtagacgggatcgttgcaatagacttggatcctgtggtttatgatgcaaaatttgaaaaacagctaggccaaataatgttactgatactttgtacatcacagatcctcttgatgcgaaccacatgggccttgtgtgaatccatcacactggctaccggacccctgaccactctctgggagggatctccaggaaaattctggaataccacgatagcagtgtccatggcaaacatcttcaggggaagttatctagcaggagcaggtctggctttctcattaatgaaatctttaggaggaggcaggagaggtacgggagctcaaggggaaacactgggagaaaaatggaaaagacagttaaaccaattgagcaagacagaattcaacacctacaaaaggagtgggattatggaggtggacagatccgaagccaaagagggactgaaaagaggagaaacaactaaacatgcagtgtcgagaggaacagccaaactgaggtggtttgtggagaggaacctcgtgaaaccagaaggaaaagtcatagacctcggttgtggaagaggtggctggtcatattattgtgctgggctgaagaaagtcactgaagtgaaaggatacacaaaaggaggacttggacatgaggaacccatcccaatggcgacctatggatggaacctagtaaagctacactctggaaaagatgtattttttatgccacctgagaaatgtgacacccttctgtgtgatattggtgagtcctctccgaacccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaaccgattcacaatggctcacaggaagccaacatatgaaagagacgtggatttaggcgctggaacaagacatgttgcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgaaattgctcacaaaaccatgggatgtcatccccatggtcacacaaatagctatgactgataccacaccctttggacaacagagagtgtttaaagagaaagttgacacgcgcacaccaagagcaaagcgaggcacaacacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaatcaatggaactcagcaaaagaagcagtggaagacgaaaggttttggaatctcgtgcacagagagagggagcttcataaacagggaaaatgtgccacgtgtgtctacaacatgatggggaagagagagaaaaagttaggagagtttggaaaagcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccggggggaaacatgtatgcagatgatacagccggatgggacacaagaataacagaggatgatcttcagaatgaggctaaaatcactgacatcatggagcctgaacatgctctattggctacgtcaatttttaagctgacttatcaaaataaggtggtgagggtgcaaagaccagcaaaaaatggaaccgtgatggatgttatatccagacgtgaccagagaggaagtggacaggtcggaacatatggcttaaatactttcaccaatatggaggtccaactaataagacaaatggagtctgaaggaatctttttacccagcgaactggaaacccccaatctagctgagagagtccttgactggttggaaaaacatggcgccgaaaggctgaaaagaatggcaatcagcggagatgattgcgtggtgaaaccaattgacgacaggttcgctacagccttaacagctctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcaactgatgtacttccacaggagagacctgagactggcggctaacgctatctgttcagccgtcccagttgattgggtcccaaccagccgtacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctaataggcttgacagcgagggccacctgggccaccaacatacaagtagccataaaccaagtgagaaggctcatcgggaatgagaattatctagattacatgacatcaatgaagaggttcaagaatgagagtgatcccgaaggggcactctggtaa

SEQ ID NO: 5636 - RNA, 9879 nt, synthetic construct
  misc_feature 1..9879: note = derived and/or modified CDS sequence (wt) from DENV-1__GU131833__SS-prME
  source 1..9879: mol_type = other RNA
tccgtgaccatgctcctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaaccttggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgcggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcaaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggttacattcaagacagctcatgcaaagaaacaggaagtagtcgtactgggatcacaggaaggagcaatgcacactgcgttgactggggcgacagaaatccagacgtcaggaacgacaacaatctttgcaggacacctgaaatgcagactaaaaatggataaactgactttaaaggggacgtcatacgtgatgtgcacaggctcatttaagctagagaaggaagtggctgagacccagcatggaactgttctagtgcaggtcaaatacgaaggaacagacgcgccatgcaagatcccctttttgacccaagatgagaaaggagtgacccagaatgggagattaataacagccaatcccatagttactgacaaagaaaaaccagtcaacattgagacagaaccaccttttggtgagagctacatcgtggtaggggcaggtgaaaaagctttgaaactaagctggttcaagaaaggaagcagcatagggaaaatgttcgaagcaaccgcccgaggagcacgaaggatggctatcctgggagacaccgcatgggacttcggctctataggaggagtgttcacatctgtgggaaaattggtacaccaggtttttggaaccgcatatggggttctgttcagcggtgtttcttggaccatgaaaataggaatagggattctgctgacatggttggggttaaattcaaggagcacgtcactttcgatgacgtgcattgcagttggcatggttacactgtacctaggagtcatggttcaagcggactcgggatgtgtaatcaactggaagggcagagaactcaaatgtggaagtggcatttttgtcactaatgaagtccacacttggacagagcaatacaaattccaggctgactccccaaaaagactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgattaggccacaacccatggaacacaaatactcatggaaaagctggggaaaagctaaaatcataggagcagacatacaaaataccaccttcatcatcgacggcccagataccccagaatgccccgatgaccaaagagcgtggaacatttgggaagttgaggactatgggtttggaattttcacgactaacatatggctgaaattgcgtgactcctacacccaaatgtgtgatcaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacagcagggccatggcacctaggcaagttggaattggattttgacttgtgtgaaggtaccacagttgttgtggatgaacattgtggaaatcgaggtccatctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattgggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttggaggagctaggggatggacttgcaatgggtatcatgatgttaaaattattgactgaatttcagccacaccagttatggaccaccttactgtctctgacattcatcaaaacaactctttctttggattatgcatggaaaacaacggctatggcactgtcaatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactcctcaaaaatgatgtgccgttggccggcccactaatagctggaggcatgctaatagcatgttatgtcatatctggaagctcagccgatttatcattggagaaagcggctgaggtgtcctgggaacaagaagcagaacactccggtacctcacacaacatattagtagaggtccaagatgacggaactatgaaaataaaagatgaagagaaggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttgggcaggtcccaagtaggagtgggagttttccaaaacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggcgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagaaattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaaaagtgaacacacaggaagggagatagttgacctcatgtgccacgccacttttaccatgcgtctcttatccccagtgagagttcccaactacaacatgattattatggatgaagcacatttcaccgatccagccagcatagcggccagagggtacatctcaacccgagtgggtatgggtgaagcagctgcgatctttatgacagccactcccccaggatcggtagaggcctttccacagagcaatgcagttatccaagatgaggaaagagacattcctgagagatcatggaactcaggctacgactggatcactgattttccaggtaaaacagtctggtttgtcccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgataatataaacacaccagaagggatcatcccagccctctttgagccagagagggaaaagagtgcagcaatagacggggagtacagactgcggggagaagcaaggaaaacgttcgtggagctcatgagaagaggagatctaccagtttggctatcctataaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccactggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgctatggaggaactaccagacaccatagaaacattgatgcttctagctttgatagctgtgttgactggtggagtgacgctgttcttcctatcaggaaaaggtctagggaaaacatccattggcttgctctgcgtgacggcctcaagcgcactgttatggatggctagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggtcatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagccatattgatgggacttgacaagggatggccaatatcgaagatggacataggagtcccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaactgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggcgactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggggagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaaaaaagtcactgaagtgaagggatacacaaaaggaggacctggacatgaggaacctatcccaatggcgacctatggatggaacctagtaaagctacactctggaaaagatgtattttttatgccacctgagaaatgtgacacccttttgtgtgatattggtgagtcctctccgaatccaactatagaagaaggaagaacgttacgtgttctaaaaatggtggaaccatggctcagaggaaaccaattctgcataaaaattctaaatccttacatgccaagtgtggtagaaactctggagcaaatgcaaagaaaacatggagggatgctagtgcgaaacccactttcaagaaactccacccatgaaatgtactgggtttcatgtggaacaggaaatattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgacgaggacaatccatacaaaacatgggcttatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaggtggttgtggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagccgtgcaatatggtacatgtggctgggagcacgctttctggagttcgaagcccttggtttcataaatgaagatcactggtttagtagagagaattcactcagtggagtggaaggagaaggactgcacaaacttggatacatactcagagacatatcaaagattccggggggaaacatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgtcatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgcaacagccttaacagctctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgttcagccgtcccagttgattgggtcccaaccagccgcacaacatggtcaatccatgcccaccaccaatggatgacaacagaagacatgttatcagtgtggaatagggtttggatagaggaaaacccatggatggaggacaaaactcatgtatccagttgggaggaagttccatacctagggaaaagggaagatcaatggtgtggatccctgataggcttgacagcgagggccacctgggccaccaacatacaagtagccataaaccaagtgagaaggctcatcgggaatgagaattatctagattatatggcatcaatgaagagattcaagaatgagagtgatcccgaaggggcactctggtaa

SEQ ID NO: 5637 - RNA, 9879 nt, synthetic construct
  misc_feature 1..9879: note = derived and/or modified CDS sequence (wt) from DENV-1__GU131834__SS-prME
  source 1..9879: mol_type = other RNA
tccgtgaccatgctcctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgctataggaacatccatcactcagaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgcggactattcggaaagggaagtctattgacgtgtgccaagttcaagtgtgtgacaaaactagaaggaaagatagttcaatatgaaaacttaaaatattcagtgatagtcactgtccacactggggaccagcaccaggtgggaaacgagaccacagaacatggaacaattgcaaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccatggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagactaaaaatggataaactgactttaaaggggatgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaaactttgaaactaagctggttcaagaaaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgtttagcggtgtttcttggaccatgaaaataggaatagggattctgctgacatggttgggattaaattcaaggagcacgtcactttcgatgacgtgcattgcagttggcatggtcacactgtacctaggagtcatggttcaagcggactcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaacggaattttggcccaagggaaaaaaatgattaggccacaacccatggaacacaaatactcatggaaaagctggggaaaagctaaaatcataggagcagacatacaaaataccaccttcatcatcgacggcccagacaccccagaatgtcccgatggccaaagagcatggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacagcagggccatggcacctaggtaagttggaactggattttgacttgtgtgaaggtaccacagttgttgtggatgaacattgtggaaatcgaggtccatctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttactgtctctgacatttgtcaaaacaactctctcattggattatgcatggaaaacaacggctatggtactgtctatcgtgtctctctttcctttatgcctgtctacgacctcccaaaaaacaacatggcttccggtgctgttaggatcttttggatgcaaaccattaaccatgttttttataacagaaaacaaaatctggggaaggaaaagttggcccctcaatgaaggaattatggctattggaatagtcagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttgggcaggtcccaagtaggagtgggagtcttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggcgaagttggagccatagctctagatttcaaacccggcacatctggatctcccattgtgaacagagagggaaaaatagtgggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcaggaaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgattttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggatgccagaacatactctgatccactggccctgcgcgagtttaaagagtttgcagcaggaagaagaagtgtttcaggtgacctgatattggaaatagggaaacttccacaacatttgacgctaagagcccagaatgctctggacaacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtctagggaaaacatctattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgctacaatgctggacgtagacctacgcccagcttcagcctggaccctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaaggaaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaagttacactctggaaaagatgtattttttatgccacctgagaaatgtgacacccttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctagagttcgaagcccttggtttcatgaatgaagatcactggtttagtagagagaattcactcagtggagtggaaggagaaggactgcacaaacttggatacatactcagagacatatcaaagattccggggggaaatatgtacgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgaccagagaggaagtggacaggtcggaacttatggcttaaatactttcaccaatatggaggtccaactaataagacaaatggagtctgaaggaatctttttacccagcgaattggaaacccccaacctagctgagagagttcttgactggttggaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcccgaaggagcactttggtaa

SEQ ID NO: 5638 - RNA, 9879 nt, synthetic construct
  misc_feature 1..9879: note = derived and/or modified CDS sequence (wt) from DENV-1__GU131835__SS-prME
  source 1..9879: mol_type = other RNA
tccgtgaccatgctcctcatgctgctgcccacagccctggcgttccatttgaccacacgagggggagagccacacatgatagttagtaagcaggaaagaggaaagtcactcttgtttaagacctctgcaggtgtcaatatgtgcactctcatcgcgatggacttgggagagttatgtgaggacacaatgacctacaaatgtccccggatcactgaggcggaaccagatgacgttgactgctggtgcaatgccacagacacatgggtgacctatgggacgtgttctcaaaccggcgaacacagacgagacaaacgttccgtggcactggccccacacgtgggacttggtctagaaacaagaaccgaaacatggatgtcctctgaaggcgcctggaaacaaatacaaagagtggagacttgggttttgagacacccaggattcacggtgatagccttttttttagcacatgccataggaacatccatcactcagaaagggattattttcattttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggttacgaaccctgccgtcttgcgcaaactgtgcattgaagctaaaatatcaaacaccaccaccgattcaagatgtccaacacaaggagaggctacactggcggaagaacaagacgcgaactttgtgtgtcgccgaacgtttgtggacagaggttggggtaatggctgcggactattcggaaagggaagcctattgacgtgtgccaagttcaagtgcgtgacaaaactagaaggaaagatagttcaatatgaaaacttaaaatattcagtgatagtcactgtccacactggggaccagcaccaggtgggaaacgagactacagaacatggaacaattgcaaccataacacctcaagctcctacgtcggaaatacagctgaccgactacggagccctcacattggactgctcacctagaacggggctggattttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacacagcgttgactggggcgacagaaatccagacgtcaggaacgacaacaatctttgcaggacacctgaaatgcagactaaaaatggataaactgactttaaaggggacgtcatatgtgatgtgcacaggctcattcaagctagagaaggaagtggctgagacccagcatggaactgttctagtgcaggtcaaatacgaaggaacagacgcgccatgcaagattcccttttcgacccaagatgagaaaggagtgacccagaatgggagactgataacagccaatcccatagttactgacaaagaaaaaccagtcaacattgagacagaaccaccttttggtgagagctacatcgtggtaggggcaggtgaaaaagctttgaaactaagctggttcaagaaaggaagcagcatagggaaaatgttcgaagcaaccgcccgaggagcacgaaggatggccatcctaggagacaccgcatgggacttcggctctataggaggagtgttcacatctgtgggaaaattggtacaccaggtatttggaaccgcatatggggttctgttcagcggtgtttcttggaccatgaaaataggaatagggattctgctgacatggttgggattaaattcaaggagcacgtcactttcgatgacgtgcattgcagttggcatggtcacactgtacctaggggtcatggttcaagcggactcgggatgtgtaatcaactggaagggcagagaactcaaatgtggaagtggcatttttgtcactaatgaagtccacacttggacagagcaatacaaattccaggctgactccccaaaaagactgtcagcagccattggaaaggcatgggaggagggcgtgtgtggaattcgatcagccacgcgccttgagaacatcatgtggaagcaaatatcaaatgaactgaaccacattctacttgaaaatgacatgaaattcacagtggttgtaggagacgctaatggaattttggcccaaggaaaaaaaatgattaggccacaacccatggaacacaaatactcatggaaaagctggggaaaagctaaaatcataggagcagacatacaaaataccaccttcatcatcgacggcccagataccccagaatgccccgatgaccaaagagcatggaacatctgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgtacctggccgaaatcccacactctatggagcaatggagttttggaaagtgaaatgataatcccaaagatatatggaggaccaatatctcagcacaactacagaccagggtatttcacacaaacagcagggccatggcacctaggcaagttggaattggattttgacttgtgtgaaggtaccacagttgttgtggatgaacattgtggaaatcgaggtccatctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgtttttctccttcttataatgggacaattgacatggaatgatctgattaggttatgcatcatggttggagctaatgcctcagacaggatggggatgggaacaacatacctagccttgatggctactttcaaaatgagaccaatgttcgctgttgggctattatttcgcagactaacatccagagaagttcttcttctcacgattggattaagcctggtggcatccgtggagctaccaaattctttggaggagctaggggatggacttgcaatgggtatcatgatgttaaaattattgactgaatttcagccacaccagttatggaccaccttactgtctctgacatttatcaaaacaactctttcattggattatgcatggaaaacaacggccatggtactgtcaatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactcctcaaaaatgatgtgccgttggccggcccactaatagctggaggcatgctaatagcatgctatgtcatatccggaagctcagccgatttatcattggagaaagcggctgaggtgtcctgggaacaagaagcagaacactccggtacctcacacaacatattagtggaggtccaagacgatggaactatgaaaataaaagatgaagagagggatgacacactcaccatactccttaaagcaactttgctggcagtctcaggagtgtacccaatgtcaataccagcaactctttttgtgtggtatttttggcagaaaaagaaacagagatcaggagtgttatgggacacacccagccctccggaagtagaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggacttgatctcatatggaggaggctggaggtttcaaggatcatggaacacgggagaagaagtgcaggtgatagctgttgaaccaggaaaaaaccccaaaaatgtacagacaacgccgggtaccttcaagactcctgaaggcgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccatgaaaaggaaactgcgtacgttaatcttggctcccacaagagttgtcgcctctgaaatggcagaggcgctcaagggaatgccaataagataccagacaacagcagtgaagagtgaacacacaggaagggagatagttgacctcatgtgccacgccacttttaccatgcgtctcttatccccagtgagagttcccaattacaacatgattattatggatgaagcacattttaccgatccagccagcatagcggccagagggtacatctcaacccgagtgggtatgggtgaagcggctgcgatctttatgacagccactcccccaggatcggtggaggcctttccacagagcaatgcagttatccaagatgaggaaagagacattcctgagagatcatggaactcaggctacgagtggatcactgattttccaggcaaaacagtctggtttgttccaagcatcaaatcaggaaatgacattgccaactgtttaagaaagaatggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagatggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccactggccctgcgcgagttcaaagagtttgcagcaggaagaagaagtgtctcaggtgatctaatattggaaatagggaaacttccacaacacttgacgctaagagcccagaatgctctggataacttggtcatgttgcacaattccgaacaaggaggaaaagcctatagacatgctatggaggaactaccagacaccatagaaacattgatgcttctagctttgatagctgtgttgactggtggagtgatgctgttcttcctatcaggaaaaggtctagggaaaacatccattggcttgctctgtgtgacggcctcaagcgcactgttatggatggccagtgtggagccccattggatagcggcctccatcgtactagagttctttttgatggtgctgctcattccagagccagacagacagcgcactccacaggacaaccagctagcatatgtagtgataggtttgttattcatgatactgacagtggcagccaatgagatgggattattggaaaccacaaagaaagacctggggattggccatgcagccgccgaaaaccaccaacatgctacaatgctggacgtagacctacgtccagcttcagcctggactctctatgcagtagctacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccgaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttttcattaatgaaatctttaggaggaggtaggagaggtacgggagctcaaggggaaacactgggagagaaatggaaaagacagttaaaccaactgagcaagccagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggttggtcatattattgtgccgggctgaagaaagtcaccgaagtgaagggatacacaaaaggaggacctggacatgaggaacctatcccaatggcgacctatggatggaacctagtaaagctacactctggaaaagatgtattttttatgccacctgagaaatgtgacacccttttgtgtgatattggtgagtcctctccgaatccaactatagaagaaggaagaacgttacgtgtcctaaagatggtggaaccatggctcagaggaaaccaattctgcataaaaatcctaaatccttacatgccaactgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaatcgattcacaatggctcacaggaagccaacatatgaaagagacgtggacttaggcgctggaacaagacacgtggcagtggaaccagaggtagccaacctagatatcattggccagaggatagagaatataaaaaatgaacacaagtcaacatggcattatgatgaggacaatccatacaaaacatgggcctaccatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacaaattatggaggtgacagccaagtggttatggggttttctttccagaaacaaaaaacccagaatctgcacaagagaagagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgcgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaagggctgcacaaacttggatacatactcagagacatatcaaggattccggggggaaatatgtatgcagatgatacagccggatgggacacaagaataacagaggatgatcttcagaatgaggctaaaatcactgacatcatggagcctgagcatgctctattggccacgtcaatttttaagctgacttatcaaaacaaggtggtgagggtgcaaagaccagcaaaaaatggaaccgtgatggatgttatatccagacgtgaccagagaggaagcggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtaaaaccaattgacgacaggttcgcaacatccttaacagctctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcctgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccaccaatggatgactacagaagacatgttatcagtgtggaatagggtttggatagaggaaaacccatggatggaggacaaaactcatgtatccagttgggaagaagttccatacctagggaaaagggaagaccaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatctcgaaggggcactctggtaa

SEQ ID NO: 5639 - RNA, 9879 nt, synthetic construct
  misc_feature 1..9879: note = derived and/or modified CDS sequence (wt) from DENV-1__GU131836__SS-prME
  source 1..9879: mol_type = other RNA
tccgtgaccatgctcctcatgctgctgcctacagccctggcgttccatttgaccacacgaggaggagagccacacatgatagttagtaagcaggaaagaggaaagtcactcttgtttaagacctctgcaggtgtcaatatgtgcactctcattgcgatggatttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggacttggtctggaaacaagaaccgaaacatggatgtcttctgaaggcgcctggaaacaaatacaaagagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaactttggacattgaactcttgaagacggaggtcacgaaccctgccgttttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggatgcggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcaaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcctcaacatcccaagagacctggaacagacaagatttactggtcacattcaagacagctcatgcaaagaaacaggaagtagtcgtactgggatcacaggaaggagcaatgcacactgcattgactggggcgacagaaatccagacgtcaggaacgacaacaatctttgcaggacacctgaaatgcagactaaaaatggataaactgactttaaaggggacgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagttactgacaaagaaaaaccagtcaacattgagacagaaccaccttttggtgagagctacatcgtggtaggggcaggtgaaaaagctctgaaactaagctggttcaagaaaggaagcagcatagggaaaatgttcgaagcaaccgcccgaggagcacgaaggatggctatcctgggagacaccgcatgggacttcggctctataggaggagtgttcacatctgtgggaaaattggtacaccaggtttttggaaccgcatatggggttctgttcagcggtgtttcttggaccatgaaaataggaatagggattctgctgacatggttgggattaaattcaaggagcacgtcactttcgatgacgtgcattgcagttggcatggttacactgtacctaggagtcatggttcaagcggactcgggatgtgtaatcaactggaagggcagagaactcaaatgtggaagtggcatttttgtcactaatgaagtccacacttggacagagcaatacaaattccaggctgactccccaaaaagactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggtccaagggaaaaaaatgattaggccacaacccatggaacacaaatactcatggaaaagctggggaaaagctaaaatcataggagcagacatacaaaataccaccttcatcatcgacggcccagataccccagaatgccccgatgaccaaagagcgtggaacatttgggaagttgaggactatgggtttggaattttcacgactaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctgtcgagagcctccttcatagaagtcaagacatgcacctggccaaaatctcacactctatggagcaatggagttttggaaagtgaaatgataatcccaaagatatatggagggccaatatctcagcacaactacagaccagggtatttcacacaaacagcagggccatggcacctaggcaagttggaattggattttgacttgtgtgaaggtaccacagttgttgtggatgaacattgtggaaatcgaggtccatctctcagaactacaacagtcacaggaaagataatccatgaatggtgttgcagatcctgcacgttaccacccttacgtttcagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattatttcgcagactaacatccagagaagttcttcttctcacgattggattaagcttggtggcatccgtggagctaccaaattctttggaggagctaggggatggacttgcaatgggtatcatgatgttaaaattattgactgaatttcagccacaccagttatggaccaccttactgtctctgacatttatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaagcagaacactccggtacctcacacaacatattagtagaggtccaagatgatggaactatgaaaataaaagatgaagagaaggatgatacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaagaatgtacagacaacgccgggtaccttcaagactcctgaaggcgaagttggagccatagctctagattttaaacccggcacatctggatctcccatcgtgaacagagagggaaaaatagttggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcaggaaaaacaagaagatatcttccggccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagttgacctcatgtgccacgccacttttaccatgcgtctcttatccccagtgagagttcccaattacaacatgatcattatggatgaagcacattttaccgatccagccagtatagcggccagagggtacatctcaacccgagtgggtatgggtgaagcagctgcgatctttatgacagccactcccccaggatcggtagaggcctttccacagagcaatgcagttatccaagatgaggaaagagacattcctgagagatcatggaactcaggctacgactggattactgattttccaggtaaaacagtctggtttgtcccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggctgacagggtaatagacccaaggcggtgcttgaaaccggtaatactaaaagatggtccagagcgtgtcattctagccggaccgatgccagtgactgtggccagtgcagcccagaggagaggaagaattggaaggaaccaaaacaaggaaggtgaccagtatgtttacatgggacagcctttaaataatgatgaggatcatgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccactggccctgcgcgagtttaaagagtttgcagcaggaagaaggagtgtctcaggtgacctaatattggaaatagggaaacttccacaacatttgacgctgagagcccagaatgctctggataacttggtcatgttgcacaattccgaacaaggaggaaaagcctatagacatgctatggaggaactaccagacaccatagaaacattgatgcttctagctttgatagctgtgttgactggtggagtgacgctgttcttcctatcaggaaaaggtctagggaaaacatccattggcttgctctgtgtgatggcctcaagcgcactgctatggatggccagtgtggagccccattggatagcggcctccatcatactagaattctttttgatggtgctgctcattccagagccagacagacaacgtactccacaggacaaccagctagcatatgtggtgataggtttgttattcatgatactgacagtggcagccaatgagatgggattattggaaaccacaaagaaagacctggggattggccatgtagccgccgaaaaccaccaacatgccacaatgctggacgtagacctacgtccagcttcagcctggactctctatgcagtagccacaacagttatcactcccatgatgagacacacaattgaaaatacaacggcaaacatttccctgacagccattgcaaaccaggcagctatattgatgggacttgacaagggatggccaatatcgaagatggacataggagttccacttctcgccttagggtgctattcccaggtgaacccattaacactgacagcggcggtgttgatgttagtggctcattatgccataattggaccaggactgcaagcaaaggccactagagaagctcaaaaaaggacagcggccggaataatgaaaaatccaactgtagacgggattgttgcaatagacttggatcctgtggtttatgatgcaaaatttgaaaaacagctaggccaaataatgttactgatactttgtacatcacagatcctcctgatgcggaccacatgggccttgtgtgaatccatcacactggcgactggacccctgaccactctctgggagggatctccaggtaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaaccaaacacgcagtgtcgagaggaacagccaaactgaggtggtttgtggagaggaacctcgtgaaaccagaagggaaagtcatagacctcggttgtggaagaggtggctggtcatattattgtgctgggttgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttttgtgtgatattggtgagtcctctccgaatccaactatagaagaaggaagaacgttgcgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaatattgtgtcggcagtgaacatgacatccagaatgttactgaatcgattcacaatggctcacaggaagccaacatatgaaagagacgtggacttaggcgctggaacaagacacgtggcagtggaaccagaggtgcccaacctagatatcattggtcagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtcacagccaagtggttgtggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaactaggagagtttggaaaggcaaaaggaagccgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctggacatgctctattggctacgtcaatttttaagctgacttatcaaaacaaggtggtgagggtgcaaagaccagcaaaaaatggaaccgtgatggatgttatatccagacgtgaccagagaggaagtggacaggtcggaacttatggcttaaacactttcactaatatggaggtccaactgataagacaaatggagtctgaaggaatctttttgcccagcgaattggaaacccccaatctagctgagagagttctcgactggttggaaaaacatggcgccgaaaggctgaaaagaatggcaatcagcggagatgattgcgtggtgaaaccaattgacgacaggttcgcaacagccttaacagctctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtgtcacaaggcgccggatggagtctgagagaaactgcttgcctaggtaagtcatatgcacaaatgtggcagctgatgtacttccacaggagagacctgagactagcggctaacgctatctgttcagccgtcccagttgattgggtcccaaccagccgcacaacctggtcaatccatgcccaccatcaatggatgacaacagaagacatgttatcagtgtggaatagggtttggatagaggaaaacccatggatggaggacaaaactcatgtatccagttgggaagaagtcccatacctagggaaaagggaagatcaatggtgtggatccctgataggtttgacagcaagggccacctgggccaccaacatacaagtagccataaaccaagtgagaaggctcatcgggaatgagaattatctagattacatgacatcaatgaagagattcaagaatgagagtgatcccgaaggggcactctggtaa

SEQ ID NO: 5640 - RNA, 9879 nt, synthetic construct
  misc_feature 1..9879: note = derived and/or modified CDS sequence (wt) from DENV-1__GU131837__SS-prME
  source 1..9879: mol_type = other RNA
tccgtgaccatgctcctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagataaacgttccgtggcactggccccacacgtgggacttggtctagaaacaagaaccgaaacatggatgtcctctgaaggcgcctggaaacaaatacaaagagtggagacttgggctttgagacacccaggattcacggtgatagccctttttttagcacatgctataggaacatccatcactcagaaagggatcattttcatcttgctgatgctggtgacaccatcaatggctatgcgatgtgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaatcctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgcggactattcggaaagggaagtctattgacgtgtgccaagttcaagtgtgtgacaaaactagaaggaaagatagttcaatatgaaaacttgaaatattcagtgatagtcactgtccacactggggaccagcaccaggtgggaaacgagaccacagaacatggaacaattgcaaccataacacctcaagctcctacgtcggaaatacagctgaccgactacggagccctcacattggactgctcacctagaacagggctggactttaatgagatggtgctattgacaatgaaagaaaaatcatggcttgtccacaaacaatggtttctagacttaccactgccatggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagactaaaaatggataaactgactttaaaagggatgtcatatgtgatgtgcacaggctcatttaagctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagaaaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgttcagcggtgtttcttggaccatgaaaataggaatagggattctgctgacatggttgggattaaattcaaggagcacgtcactttcgatgacgtgcattgcagttggcatggtcacactgtacctaggagtcatggttcaagcggactcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaacggaattttggcccaagggaaaaaaatgattaggccacaacccatggaacacaaatactcatggaaaagctggggaaaagctaaaatcataggagcagacatacaaaataccaccttcatcatcgacggcccagacaccccagaatgtcccgatggccaaagagcatggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacagcagggccatggcacctaggtaagttggaactggattttgacttgtgtgaaggtaccacagttgttgtggatgaacattgtggaaatcgaggtccatctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttactgtctctgacatttgtcaaaacaactctttcattggattatgcatggaaaacaacggctatggtactgtcaatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttgggcaggtcccaagtaggagtgggagtcttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggcgaagttggagccatagctctagatttcaaacccggcacatctggatctcccattgtgaacagagagggaaaaatagtgggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcaggaaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacctttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgattttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttgaataatgatgaggatcacgctcattggacagaagcaaaaatgctccttgacaatataaacacaccagaagggatcatcccagccctctttgagccagagagagaaaagagtgcagcgatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggatgccagaacatactctgatccactggccctgcgcgagtttaaagagtttgcagcaggaagaagaagtgtctcaggtgacctaatattggaaatagggaaacttccacaacatttgacgctaagagcccagaatgctctggacaacttggtcatgttgcacaactccgaacaaggaggaaaagcctacagacatgctatggaggaactaccagacaccatagaaacattgatgcttctagctttgatagctgtgttgactggtggagtgacgctgttcttcctatcaggaaaaggtctagggaaaacatctattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgctacaatgctggacgtagacctacgcccagcttcagcctggaccctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagatgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaaggaaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggaagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaactcggatacatactcagagacatatcaaagattccggggggaaatatgtatgcagatgatacagccggatgggacacaagaataacagaggatgatcttcagaatgaggctaaaatcaccgacatcatggagcctgaacatgctctattggctacgtcaatttttaagctgacttatcaaaacaaggtggtgagggtgcaaagaccagcaaaaaatggaaccgtgatggatgttatatccagacgtgaccagagaggaagtggacaggtcggaacttatggcttaaatactttcaccaatatggaggtccaactaataagacaaatggagtctgaaggaatctttttacccagcgaattggaaacccccaacctagctgagagagttcttgactggttggaaaaacatggcaccgaaaggctgaaacggatggcaatcagcggagatgattgcgtggtgaaaccaattgacgacaggttcgcaacagccttaacagctctgaatgacatgggaaaagtaagaaaagacataccacagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggtttgacagcgagggccacctgggccaccaacatacaagtagccataaaccaagtgagaaggctcatcgggaatgagaattatctagattacatgacatcaatgaagagattcaagaatgagagtgatcccgaaggagcactctggtaa

SEQ ID NO: 5641 - RNA, 9879 nt, synthetic construct
  misc_feature 1..9879: note = derived and/or modified CDS sequence (wt) from DENV-1__JN819415__SS-prME
  source 1..9879: mol_type = other RNA
tccgtgaccatgctcctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgacagccctttttttagcacatgccataggaacatccatcactcagaaagggatcattttcattttgctaatgctggtgacaccatcaatggccatgcgatgcgtgggaataggtaacagagacttcgttgaaggactgtcaggagcaacgtgggtggacgtggtattggagcatggaagctgcgtcaccaccatggcaaaaaataaaccaaccttggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgcggactattcggaaagggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcaaccataacacctcaagctcccacgtcggaaatacagctgaccgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacacctgaaatgcagactaaaaatggataaactgactttaaaggggacgtcatatgtgatgtgcacaggctcatttaagctagagaaggaagtggctgagacccaacatggaactgttctagtgcaggtcaaatacgaaggaacagacgcgccatgcaagatccccttttcgacccaagatgagaaaggagtgacccagaatgggagattgataacagccaatcccatagttactgacaaagaaaaaccagtcaacattgagacagaaccaccttttggtgagagctacatcgtggtaggggctggtgaaaaagctttgaaactaagctggttcaagaaaggaagcagcatagggaaaatgttcgaagcaactgcccgaggagcacgaaggatggctatcctgggagacaccgcatgggacttcggctctataggaggagtgttcacatctgtaggaaaattggtacaccaggtttttggaaccgcatatggggttctgttcagcggtgtttcttggaccatgaaaataggaatagggattctgctgacatggttgggattaaattcaaggagcacgtcactttcgatgacgtgcattgcagttggcatggttacactgtacctaggagtcatggttcaagcggactcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgccaatggaattttggcccaaggaaaaaaaatgattaggccacaacccatggaacacaaatactcatggaaaagctggggaaaagctaaaatcataggagcagacatacaaaataccaccttcatcatagacggcccagataccccagaatgccccgatgaccaaagagcgtggaacatttgggaagttgaggactatgggtttggaattttcacgactaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacagcagggccatggcacctaggcaagttggaattggattttaacttgtgtgaaggtaccacagttgttgtggatgaacattgtggaaatcgaggtccatctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcgatggtctctgcagggtcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattgtttcgcagactaacatccagagaagttcttcttctcacgattggattaagcctggtggcatccgtagagctaccaaattctttggaggagctaggggatggacttgcaatgggtatcatgatgttaaaattattgactgaatttcagccacaccagttatggaccaccttactgtctctgacatttatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactgagttcactcctcaaaaatgatgtgccgttggccggcccactaatagctggaggcatgctaatagcatgttatgtcatatccggaagctcagccgatttatcattggagaaagcggctgaggtgtcctgggaacaagaagcagaacactcaggtacctcacacaacatattagtagaggtccaagatgatggaactatgaaaataaaagatgaagagaaggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttgggcagatcccaagtgggagtgggagttttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggcgaagttggagccatagctctagattttaaacccggcacatctggatctcccatcgtgaacagagagggaaaaatagtaggtctttatggaaatggagtggtgacaacaagtggaacctacgtcagtgccattgctcaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagtagacctcatgtgccacgccacttttaccatgcgtctcttatccccagtgagagttcccaattacaacatgattattatggatgaagcacattttaccgatccagccagcatagcggccagagggtacatctcaacccgagtgggtatgggtgaagcagctgcaatctttatgacagccactcccccaggatcggtagaggcctttccacagagcaatgcagttatccaagatgaggaaagagacattcctgagagatcatggaactcaggctacgactggatcactgattttccaggtaaaacagtctggtttgtcccaagcattaaatcaggaaatgacattgccaactgtttaagaaagaacggaaaacgggtaatccaattgagcagaaaaacctttgacactgagtaccagaaaacaaaaaacaatgattgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataacgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccactggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgctatggaggaactaccagacaccatagaaacattgatgcttctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttcttcttgatggtgctgctcattccagagccagacagacagcgcactccacaggacaaccagctagcatatgtggtgataggtttgttattcatgatactgacagtggcagccaatgagatgggattattggaaaccacaaagagagacctggggattggccatgtagccgccgaaaaccaccaacatgctacaatgctggacgtagacctacgtccagcttcagcctggactctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaactgtagacgggattgttgcaatagacttggatcctgtggtttatgatgcaaaatttgaaaaacagctaggccaaataatgctactgatactttgtacatcacagatcctcttgatgcggaccacatgggccttgtgtgaatccatcacactggcgactggacccctgaccactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactaaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttttgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaatattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtaaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttgtggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaactaggagagtttggaaaggcaaaaggaagccgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccagggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatctagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgcaacagccttaacagctctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaattcatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcccgaaggggcactctggtaa

SEQ ID NO: 5642 - RNA, 9879 nt, synthetic construct
  misc_feature 1..9879: note = derived and/or modified CDS sequence (wt) from DENV-1__GU131838__SS-prME
  source 1..9879: mol_type = other RNA
tccgtgaccatgctcctcatgctgctgcccacagccctggcgtttcatttgaccacacgagggggagagccacacatgatagttagtaagcaggaaagaggaaagtcactcttgtttaagacctctgcgggcgtcaatatgtgcaccctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggaaacaaatacaaagagtggaaacttgggctttgagacacccaggattcacggtgatagctttttttttagcacatgctataggaacatccatcactcaaaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgtggactattcggaaagggaagtctattgacgtgtgccaagttcaagtgtgtgacaaaactagaaggaaagatagttcaatatgaaaacttaaaatattcagtgatagtcactgtccacactggggaccagcaccaggtgggaaacgagaccacagaacatggaacaattgcaaccataacacctcaagctcccacgtcggaaatacagctgaccgactacggagccctcacattggactgctcacctagaacagggctggactttaatgagatggtgctattgacaatgaaagaaaaatcatggcttgtccacaaacaatggtttctagacttaccactgccatggacttcgggggcttcaacatctcaagagacctggaacagacaagatttgctggtcacattcaagacagctcatgcaaagaaacaggaagtagtcgtactgggatcacaggaaggagcaatgcacacagcgttgactggggcgacagaaatccagacgtcaggaacgacaacaatcttcgcaggacacctgaaatgcagactaaaaatggataaactgaccttaaaggggatgtcatatgtgatgtgcacaggctcatttaagctagagaaggaagtggctgagacccagcatggaactgttctagtgcaggtcaaatatgaaggaacagacgcgccatgcaagatccccttctcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgtttagcggtgtttcttggaccatgaaaataggaatagggattctgctgacatggttgggattaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtgtgtggaattcgatcagccacgcgtcttgagaacatcatgtggaagcaaatatcaaatgaattgaaccacattctacttgagaatgacatgaaattcacagtggttgtaggagatgccaacggaattttggcccaaggaaaaaaaatgattaggccacaacccatggaacacaaatactcatggaaaagctggggaaaagctaaaatcataggagcagacatacaaaatactaccttcatcatcgacggcccagacaccccagaatgtcccgatggccaaagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacagcagggccatggcacctaggtaagttggaactggattttgacttgtgtgaaggtaccacagttgttgtggatgaacattgtggaaatcgaggtccatctctcagaaccacaacagtcacaggaaagataatccatgaatggtgttgcagatcctgcacgctaccccccttacgtttcagaggagaagacgggtgttggtatggcatggaaatcagaccagtaaaggagaaggaggagaatctagtcaggtcaatggtctctgcagggtcaggagaagtggatagtttttcattaggaatactatgcgtgtcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttattgtctctgacatttgtcaaaacaactctctcactggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagctcactcctcaaaaatgatgtgccgttggccgggccactaatagctggaggcatgctaatagcatgttatgtcatatccggaagctcagccgatttatcattggagaaaacggctgaagtatcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttggggaggtcccaagtaggagtgggagtcttccaagacggcgtgttccacacaatgtggcacgttaccaggggagctgtccttatgtaccaagggaagagactggaaccaagctgggccagtgtcaaaaaggacttgatctcatatggaggaggttggaggttccaaggatcatggaacacaggagaagaagtgcaggtgatagctgttgaaccaggaaaaaaccccaaaaatgtacagacaacgccgggcaccttcaagactcctgaaggcgaagttggagccatagctctagatttcaaacccggcacatctggatctcccattgtgaacagagagggaaaaatagtgggtctgtatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcagggaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattttagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctttttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggacgccagaacatactctgatccattggccctgcgcgagtttaaagagttcgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgctacaatgctagacgtagacctacacccagcttcagcctggaccctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaacatcttcaggggaagttatctagcaggagcaggtctggctttctcattaatgaaatctttaggaggaggtaggagaggtacgggagctcaaggggaaacattgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaagctacactctggaaaggatgtattttttatgccacctgagaaatgtgacacccttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacagattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgatcagagaggaagtggacaggtcggaacttatggcttaaatactttcaccaatatggaggtccaactaataagacaaatggagtctgaaggaatctttttacccagcgaattggaaacccccaacctagctgagagggctcttgactggttagaaaaacatggcgccgaaaggctgaaacgaatggcaatcagcggagatgattgcgtggtgaaaccaattgacgataggttcgcaacagccttaacagctctgaatgacatgggaaaagtaagaaaagacataccgcagtgggaaccttcaaaaggatggaatgattggcagcaagtgcctttttgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctaggaaaaagggaagaccaatggtgtggatccctgataggcttgacagcgagggccacctgggccaccaacatacaagtagccataaaccaagtgagaaggctcatcgggaatgagaattatttagattacatgacatcaatgaagagattcaagaatgagagtgatcccgaaggagcactctggtaa

SEQ ID NO: 5643 - RNA, 9879 nt, synthetic construct
  misc_feature 1..9879: note = derived and/or modified CDS sequence (wt) from DENV-1__GU131839__SS-prME
  source 1..9879: mol_type = other RNA
tccgtgaccatgctcctcatgctgctgcccacagccctggcgtttcatttgaccacacgagggggagagccacacatgatagttagtaagcaggaaagaggaaagtcactcttgtttaagacctctgcgggcgtcaatatgtgcaccctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggaaacaaatacaaagagtggaaacttgggctttgagacacccaggattcacggtgatagctttttttttagcacatgctataggaacatccatcactcagaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggcaatggctgcggactattcggaaagggaagtctattgacgtgtgccaagttcaagtgtgtgacaaaactagaaggaaagacagttcaatatgaaaacctaaaatattcagtgatagtcactgtccacactggggaccagcaccaggtgggaaacgagaccacagaacatggaacaattgcaaccataacacctcaagctcccacgtcggaaatacagctgaccgactatggagccctcacattggactgctcacctagaacagggctggactttaatgagatggtgctattgacaatgaaagaaaaatcatggcttgtccacaaacaatggtttctagacttaccactgccatggacttcgggggcttcaacatctcaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagactaaaaatggataaactgaccttaaaggggatgtcatatgtgatgtgcacaggctcatttaagctagagaaggaagtggctgagacccagcatggaactgttctagtgcaggtcaaatatgaaggaacagacgcgccatgcaagatccccttttcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgtttagcggtgtttcttggaccatgaaaataggaatagggattctgctgacatggttgggattaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtgtgtggaattcgatcagccacgcgtcttgagaacatcatgtggaagcaaatatcaaatgaattgaaccacattctacttgagaatgacatgaaattcacagtggttgtaggagatgccaacggaattttggtccagggaaaaaaaatgattaggccacaacccatggaacacaaatactcatggaaaagctggggaaaagctaaaatcataggagcagacacacaaaataccaccttcatcatcgacggcccagacaccccagaatgtcccgatggccaaagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacagcagggccatggcacctaggtaagttggaactggactttgacttgtgtgaaggtaccacagttgttgtggatgaacattgtggaaatcgaggtccatctctcagaaccacaacagtcacaggaaagataatccatgaatggtgttgcagatcctgcacgctaccccccttacgtttcagaggagaagacgggtgttggtatggcatggaaatcagaccagtaaaggagaaggaggagaatctagttaggtcaatggtctctgcagggtcaggagaagtggatagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttattgtctctgacatttgtcaaaacagctctctcattggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagctggcccctcaatgaaggaattatggctattggaatagtcagcattctactaagctcactcctcaaaaatgatgtgccgttggccgggccactaatagctggaggcatgctaatagcatgttatgtcatatccggaagctcagccgatttatcattggagaaagcggctgaagtatcctgggaacaagaagcagaacactccggtgcctcacacaacatattagtagaggtccaagatgatggaactatgaaaataaaagatgaagagagggatgacacactcactatactccttaaagcaactttgttggcagtctcaggagtgtacccaatgtcaataccagcaactctttttgtgtggtatttttggcagaaaaagaaacagagatcaggagtgttatgggacacacccagccctccggaagtggaaagagcagttcttgacaatggcatctatagaatcttgcaaagaggactgttgggcaggtcccaagtaggagtgggagtcttccaagacggcgtgttccacacaatgtggcacgttaccaggggagctgtccttatgtaccaagggaagagactggaaccaagctgggccagtgtcaaaaaggacttgatctcatatggaggaggttggaggttccaaggatcatggaacacgggagaagaagtgcaggtgatagctgttgaaccaggaaaaaaccccaaaaatgtacagacaacgccgggcaccttcaagactcctgaaggcgaagttggagccatagctctagatttcaaacccggcacatctggatctcccattgtgaacagagagggaaaaatagtgggtctgtatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcagggaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgactttccaggtaaaacagtctggtttgttccaagcatcaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctttttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggacgccagaacatactctgatccattggccctgcgcgagtttaaagagttcgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggcctagggaaaacatccattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattgttggaaaccacaaagaaagacctggggattggctatgtagccgccgaaaaccaccaacatgctacaatgctggacgtagacctacacccagcttcagcctggaccctctatgcagtagccacaacagttatcactcccatgatgagacacacaattgaaaatacaacggcaaacatttccctgaccgccattgcaaatcaggcagctatattgatgggacttgacaagggatggccaatatcgaagatggacataggagttccacttctcgccttagggtgctattcccaggtgaacccattgacactgacatcggcggtgttgatgttagtagctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaaggaaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaagctacactctggaaaggatgtattttttatgccacctgagaaatgtgacacccttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcataggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttagagagaaagttgacacgcgcacaccaagagcaaaacgaggcacaacacagattatggaggtgacagccaagtggttatggggttttctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaaggttctgggatcttgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagaccactggtttagtagagagaattcactcagtggagtggaaggagaaggactgcacaaacttggatacatactcagagacatatcaaagattccggggggaaatgtgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgatcagagaggaagtggacaggtcggaacttatggcttaaatactttcaccaatatggaggtccaactaataagacaaatggagtctgaaggaatctttctacccagcgaattggaaacccccaacctagctgagagggctcttgactggttagaaaaacatggcgtcgaaaggctgaaacgaatggcaatcagcggagatgattgcgtggtgaaaccaattgacgacaggttcgcaacagccttaacagctctgaatgacatgggaaaagtgagaaaagacataccgcagtgggaaccttcaaaaggatggaatgattggcagcaagtgcctttttgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctaggaaaaagggaagatcaatggtgtggatccctgataggcttgacagcgagggccacctgggccaccaacatacaagtagccataaaccaagtgagaaggctcatcgggaatgagaattatttagattacatgacatcaatgaagagattcaagaatgagagtgattccgaaggagcactctggtaa

SEQ ID NO: 5644 - RNA, 9879 nt, synthetic construct
  misc_feature 1..9879: note = derived and/or modified CDS sequence (wt) from DENV-1__GU131841__SS-prME
  source 1..9879: mol_type = other RNA
tccgtgaccatgctcctcatgctgctgcccacagccctggcgtttcatttgaccacacgagggggagagccacacatgatagttagtaagcaggaaagaggaaagtcactcttgtttaagacctctgtgggcgtcaatatgtgcaccctcattgcgatggacttgggagagttatgtgaggacacaatgacctacaaatgcccccggatcactgaggcggaaccagatgacgttgactgctggtgtaatgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggaaacaaatacaaagagtggaaacttgggctttgagacacccaggattcacggtgatagccttttttttagcatatgctataggaacatccatcactcaaaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgctgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgcggactattcggaaagggaagtctattgacgtgtgccaagttcaagtgtgtgacaaaactagaaggaaagatagttcaatatgaaaacttaaaatattcagtgatagtcactgtccacactggggaccagcaccaggtgggaaacgagaccacagaacatggaacaattgcaaccataacacctcaagctcccacgtcggaaatacagctgaccgactacggagccctcacattggactgctcacctagaacagggctggactttaatgagatggtgctattgacaatgaaagaaaaatcatggcttgtccacaaacaatggtttctagacttaccactgccatggacttcgggggcttcaacatctcaagagacctggaacagacaagatttgctggtcacattcaagacagctcatgcaaagaaacaggaagtagtcgtactgggatcacaggaaggagcaatgcacacagcgttgactggggcgacagaaatccagacgtcaggaacgacaacaatcttcgcaggacacctgaaatgcagactaaaaatggataaactgaccttaaaggggatgtcatatgtgatgtgcacaggctcatttaagctagagaaggaagtggctgagacccagcatggaactgttctagtgcaggtcaaatatgaaggaacagacgcgccatgcaagatccccttttcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgtttagcggtgtttcttggaccatgaaaataggaatagggattctgctgacatggttgggattaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtgtgtggaattcgatcagccacgcgtcttgagaacatcatgtggaagcaaatatcaaatgaattgaaccacattctacttgagaatgacatgaaattcacagtggttgtaggagatgccaacggaattttggcccaagggaaaaaaatgattaggccacaacctatggagcacaaatactcatggaaaagctggggaaaagctaaaatcataggagcagacatacaaaatactaccttcatcatcgacggcccagacaccccagaatgtcccgatggccaaagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacagcagggccatggcacctaggtaagttggaactggattttgacttgtgtgaaggtaccacagttgttgtggatgaacattgtggaaatcgaggtccatctctcagaaccacaacagtcacaggaaagataatccatgaatggtgttgcagatcctgcacgctaccccccttacgtttcagaggagaagacgggtgttggtatggcatggaaatcagaccagtaaaggagaaggaggagaatctagtcaggtcaatggtctctgcagggtcaggagaagtggatagtttttcattaggaatactatgcgtgtcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagactaacatccagagaagttcttctcctcactattggattaagcctggtggcatccgtggagctaccaaattctttggaggagctaggggatggacttgcaatgggtatcatgatgttaaaattgttgactgaatttcagccacaccagttatggaccaccttattgtctctgacatttgtcaaaacaactctctcactggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagctcactcctcaaaaatgatgtgccgttggccgggccactaatagctggaggcatgctaatagcatgttatgtcatatccggaagctcagccgatttatcattggagaaagcggctgaagtatcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttggggaggtcccaagtaggagtaggagtcttccaagacggcgtgttccacacaatgtggcacgttaccaggggagctgtccttatgtaccaagggaagagactggaaccaagctgggccagtgtcaaaaaggacttgatctcatatggaggaggttggaggttccaaggatcatggaacacaggagaagaagtgcaggtgatagctgttgaaccaggaaaaaaccccaaaaatgtacagacaacgccgggcaccttcaagactcctgaaggcgaagttggagccatagctctagatttcaaacccggcacatctggatctcccattgtgaacagagagggaaaaatagtgggtctgtatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcagggaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctttttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggacgccagaacatactctgatccattggccctgcgcgagtttaaagagttcgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgctacaatgctggacgtagacctacacccagcttcagcctggaccctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaagctacactctggaaaggatgtattttttatgccacctgagaaatgtgacacccttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatctagaatgttactgaaccgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacagattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaattaggagagtttggaaaagcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatacttagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgtcatatccagacgtgatcagagaggaagtggacaggtcggaacttatggcttaaatactttcaccaatatggaggtccaactaataagacaaatggagtctgaaggaatctttttacccagcgaattggaaacccccaacctagctgagagggctcttgactggctagaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcaaaaggatggaatgattggcagcaagtgcctttttgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctaggaaaaagggaagaccaatggtgtggatccctgataggcttgacagcgagggccacctgggccaccaacatacaagtagccataaaccaagtgagaaggctcatcgggaatgagaattatttagattacatgacatcaatgaagagattcaagaatgagagtgatcccgaaggagcactctggtaa

SEQ ID NO: 5645 - RNA, 9879 nt, synthetic construct
  misc_feature 1..9879: note = derived and/or modified CDS sequence (wt) from DENV-1__GQ868601__SS-prME
  source 1..9879: mol_type = other RNA
tccgtgaccatgctcctcatgctgctgcccacagccctggcgttccatttgaccacacgagggggagagccacacatgatagtcagcaagcaggaaagaggaaagtcactcttgtttaagacctctgtaggtgtcaatatgtgcactctcattgcgatggatttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtcgcactggccccacacgtgggacttggtctagaaacaagaactgaaacgtggatgtcctctgaaggcgcctggaaacaaatacaaaaagtggagacttgggctttgcgacacccaggattcacggtgatagcccttttcttggcacatgccataggaacatccatcactcagaaagggatcattttcattttgctgatgctggtaacaccatcaatggccatgcgatgcgtgggaataggcaacagagacttcgttgaaggactgtcaggagcaacgtgggtggacgtggtactggagcatggaagctgcgtcaccaccatggcaaaaaacaaaccaacattggacattgaactcttgaaaacggaggtcacgaaccctgccgtcctgcgcaaactgtgcattgaagctaaaatatcaaacaccaccaccgattcaagatgtccaacacaaggagaagccacactggtggaagaacaagacgcgaactttgtgtgtcgacgaacgttcgtggacagaggctggggtaatggctgcggactatttggaaaaggaagtctactgacgtgtgctaagttcaagtgtgtgacaagactagaaggaaagatagttcaatatgaaaacttaaaatattcagtgatagtcactgtccacactggggaccagcaccaggtaggaaacgagactacagaacatggaacaattgcaaccataacacctcaagctcctacgtcggaaatacagctgaccgactacggagccctcacattggactgctcacctagaactgggctggactttaatgagatggtgctattgacaatgaaagaaaaatcatggcttgtccacaaacaatggtttctagacttaccactgccttggacttcgggagcttcaacatcccaagagacttggaacagacaagatttgctggtcacattcaagacagctcatgcaaagaagcaggaagtagtcgtactgggatcacaggaaggagcaatgcacactgcgttgactggggcgacagaaatccagacgtcaggaacgacaacaatctttgcgggacacctgaaatgtagactaaaaatggataaactgactttaaaagggatgtcatatgtgatgtgcacaggctcatttaagctagagaaggaagtggctgagacccagcatggaactgttttagtgcaggttaaatacgaaggaacagatgcaccatgcaagatcccctttttgacccaagatgagaaaggagtgacccagaatgggagattgataacagccaatcctatagttactgacaaagaaaaaccagtcaacattgagacagaaccaccttttggtgagagctacatcgtggtaggggcaggtgaaaaagctttgaaactaagctggttcaagaaaggaagcagcatagggaaaatgttcgaagcaaccgcccgaggagcacgaagaatggccatcctgggagacaccgcatgggacttcggctctataggaggattgttcacgtctgtgggaaaattgatacaccaggtttttggaactgcatatggggttctgttcagcggtgtttcttggaccatgaaaataggaatagggattctgctgacatggttgggattaaattcaaggagcacgtcactttcaatgacgtgcattgcagttggcatggtcacactgtacctaggagtcatggttcaagcggactcgggatgtgtgatcaactggaagggcagagaactcaaatgtggaagtggcatttttgtcactaatgaagtccacacttggacagagcaatataaattccaggctgactccccaaaaagactgtcagcagccattgggaaggcatgggaggaaggcgtgtgtggaattcgatcagccacgcgtcttgagaacatcatgtggaagcaaatatcaaatgaattgaactacatcctacttgaaaatgacatgaaattcacagtggttgtaggagacgctaatggaattttggcccaagggaaaaaaatgattagaccacaacccatggaacacaaatactcatggaaaagttggggaaaagccaaaatcataggagcagacatacagaacaccacctttatcattgacggcccagatactccagaatgccccgatgaccaaagagcatggaacatttgggaagttgaggactatgggttcggaattttcacgacaaacatatggctgaaattgcgtgactcctacacccaaatgtgtgaccaccggctaatgtcagctgccatcaaggacagcaaggcagtccatgctgatatggggtactggatagaaagtgaaaagaacgagacctggaagctagcgagagcctcctttatagaagtcaagacatgcatctggccgaaatcccacactctatggagtaatggagttttggaaagtgaaatgataatcccaaagatatatggaggaccaatatctcagcacaactacagaccagggtatttcacacaaacagcagggccatggcacctaggcaagttggaattggattttgacttgtgtgaaggtaccacagttgttgtagatgaacattgtggatatcgaggtccatctctcagaactacaacagttacaggaaagataatccatgaatggtgttgcagatcctgcacgttaccccccttacgcttcagaggagaagacggatgttggtatggtatggaaatcagaccagttaaggagaaggaggagaacctagttaggtcaatggtctctgcagggtcaggagaagtggacagtttttcattaggaatactatgcgtatcaatactgattgaagaagtgatgagatccagatggagtagaaggatgctgatgactggaacactggctgttttcctccttcttataatgggacaactgacatggaatgatctgatcaggttatgcatcatggttggagccaatgcttcggacaggatggggatggggacaacgtacctagccttgatggccactttcaaaatgagaccaatgttcgctgttgggctattatttcgcagactaacatccagagaagttcttcttctcacgattggattaagcctggtggcatccgtggagctaccaaattctttagaggagctaggggatggacttgcaatgggcatcatgatgttaaaattattgactgacttccagccacaccagttatggaccaccctattgtctctaacatttatcagaacaactctttcattggattatgcatggaagacaatggctatggcactgtcaatcgtatctctctttcctttgtgtctgtctacgacctcccaaaaaacaacatggcttccggtgctgttaggatcttttggatgtaaaccattaaccatgtttctcataacagaaaacaaaatctggggaaggaaaagctggcccatcaatgaaggaattatggctgttggaatagtcagcattctactaagttcactcctcaaaaatgatgtgccgctagccggcccactaatagctggaggcatgctaatagcatgttatgtcatatccggaagctcagctgatttatcattggagaaagcggctgaggtatcctgggaagaagaagcagaacactccggcacctcacacaacatattagtggaggtccaagatgatggaactatgaaaataaaagatgaagagagggatgacacactcaccatactccttaaagcaactctgctggcagtctcaggagtgtacccaatgtcaataccagcaactctttttgtgtggtatttttggcagaaaaagaaacagagatcaggagtgttatgggacacacccagccctccggaagtggaaagggcagttcttgatgatggcatttatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaagacttgatctcatacggaggaggttggaggtttcaaggatcatggaacacgggagaagaagtgcaggtgatagctgttgaaccaggaaaaaaccccaaaaatgtacagacaacgccgggtaccttcaagactcctgaaggcgaagttggagccatagctctagattttaaacccggcacatccggatctcccatcgtgaacagagagggaaaaatagtaggtctttatggaaatggagtggtgacaacaagtggaacctacgtcagtgccatcgctcaagctaaagcatcacaagaagggcctctaccagagattgaggacgaggtgtttaagaaaagaaacttaacaataatggacctgcatccaggatcagggaaaacaagaagatatcttccagccatagtccgtgaggccataaaaaggaagctgcgcacgctaatcttggctcccacaagagttgtcgcctctgaaatggcagaggcgctcaagggaatgccaataagataccagacaacagcagtgaagagtgaacatacaggaagggagatagttgacctcatgtgccatgccacttttaccatgcgtctcttatctccagtgagagttcccaattacaacatgattatcatggatgaggcacattttactgatccagccagcatagcggccagagggtacatctcaacccgagtgggtatgggtgaagcagctgcgatcttcatgacagccactcccccaggatcggtggaggcctttccacagagcaatgcagttatccaagatgaggaaagagacattcctgagagatcatggaactcaggctacgactggatcactgattttccaggtaaaacagtttggtttgttccaagcatcaaatcaggaaatgacattgccaactgtttaagaaagaacggaaaacgggtgattcaactgagcaggaaaacctttgacactgagtaccagaaaacaaaaaacaatgactgggactacgttgtcacaacagacatttccgaaatgggagcaaatttccgggccgacagggtaatagatccaaggcggtgcttgaaaccggtaatactaaaggatggtccagagcgcgtcattctagccggaccgatgccagtgactgtggccagtgccgcccagaggagaggaagaattggaaggaaccaaaacaaagaaggtgatcagtacatttacatgggacagcctttaaataatgatgaggatcacgctcattggacagaagcaaaaatgctccttgacaatataaacacaccagaagggatcatcccagccctctttgagccagagagagaaaaaagtgcagcaatagacggggagtacagactgcggggagaagcaaggaaaacattcgtggagctcatgagaagaggagatctaccagtttggctatcctacaaagttgcctcagaaggtttccaatactccgacagaagatggtgctttgatggggaaaggaataaccaggtgttggaggagaacatggacgtggagatctggacaaaggaaggagaaagaaagaaattgcgaccccgctggttggatgctagaacatactctgatccactggccctgcgcgagtttaaagagtttgcagcaggaagaagaagtgtctcaggtgacctaatattggaaataggaaaacttccacaacatttgacgctaagagcccagaatgctctggacaacttggtcatgttgcacaattccgaacaaggaggaaaagcctacagacatgctatggaagaactaccagacaccatagaaacattgatgctcctagctttgatagctgtgctgactggtggagtgacgctgttcttcctatcaggaaaaggtctagggaaaacatccattggcctactctgtgtgatggcctcaagcgcactgttatggatggccagtgtggagccccattggatagcggcctccatcatattagagttctttctgatggtgctgctcattccagagccagacagacagcgcactccacaggacaaccagttagcatatgtggtgataggtttgttattcatgatactgacagtggcagctaatgagatgggattgctggaaaccacaaagaaagacctggggattggccatgtagccgccgaaaaccaccaccatgccacaatgctggacgtagacctacgtccagcttcagcctggaccctctatgcagtagccacaacagttatcacccccatgatgagacacacaattgaaaatacaacggcaaatatttccctgacagccattgcaaaccaggcagctatattgatggggcttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttacaatagacttggatcctgtggtttatgatgcaaaatttgaaaaacagctaggtcaaataatgttactgatactttgtacatcacagattctcttgatgcggaccacatgggccttgtgtgaatccatcacactggctactggacccttgaccactctttgggagggatctccaggaaaattctggaataccacgatagcagtgtccatggcaaacatcttcaggggaagttatctagcaggagcaggtctggccttctcattgatgaaatctttaggaggaggtaggagaggtacgggagctcaaggggaaacactgggagaaaaatggaaaagacagctaaaccaactgagcaagtcagaatttaacacctacaaaaggagtgggattatggaggtggacagatccgaagccaaagagggattgaaaagaggagaaacaaccaaacatgcagtgtcgagaggaacagccaaactgaggtggtttgtggagaggaacctcgtgaaaccagaagggaaagtcatagacctcggttgtgggagaggtggctggtcatattactgcgctgggctgaagaaagtcactgaagtgaagggatacacaaaaggaggacctggacatgaggaacccatcccaatggcgacctatggatggaacctggtaaagctacactctgggaaagatgtattcttcacaccacctgagaaatgtgacacccttttgtgtgacattggtgagtcctctccaaatccaactatagaagaaggaagaacattacgtgttctaaagatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagagaacataaaaaatgaacacaagtcaacatggcattatgatgaagacaatccatacaaaacatgggcctatcatggatcatatgaggtcaagccatcaggatcagcctcatccatggtgaatggcgtggtgagattgctcaccaaaccatgggatgttatccccatggtcacacaaatagctatgactgataccacacccttcggacaacagagggtgtttaaagagaaagttgacacgcgcacaccaagagcaaaaagaggcacagcacaaattatggaggtgacagccaagtggttatggggtttcctatccagaaacaaaaaacccagaatctgcacaagagaggagttcacaagaaaagttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtttacaatatgatggggaagagagaaaaaaaattaggagagttcggaaaagcaaaaggaagtcgtgcaatatggtacatgtggctgggagcacgctttctagagtttgaagcccttggtttcatgaatgaagatcactggttcagtagagagaattcactcagtggagtggaaggagaaggactgcacaaacttggatacatactcagagacatatcaaagattccggggggaaatatgtatgcagatgacacagccggatgggacacaagaataacagaggatgatcttcagaatgaggctaaaatcactgacatcatggagcctgaacatgctctattggctacgtcaatttttaaactgacctaccaaaataaggtggtgagggtgcaaagaccagcaaaaagtggaaccgtgatggatgtcatatccagacgtgaccagagaggaagtggacaggtcggaacttatggcttaaatactttcaccaatatggaggtccaattaataagacaaatggagtctgaaggaattttttcacccagcgaattggaaacccccaatctagctaagagagttcttgactggttggaaaaacaaggcgccgaaaggctgaaaagaatggcaattagcggagatgattgtgtggtgaaaccaattgatgacaggttcgcaacagccttaacagctttgaatgatatgggaaaagtaagaaaagacataccgcagtgggaaccttcaaaaggatggaatgactggcagcaagtccctttctgttcacaccacttccaccagctgatcatgaaagatggaagagaaatagtggtgccatgccgcaaccaagatgaacttgtgggcagggctagagtatcacaaggcgccggatggagcctgagagaaactgcttgcctaggcaagtcatatgcacaaatgtggcagctgatgtactttcacaggagagacctgagactagcggctaatgctatctgttcagccgtcccagttgattgggtcccaaccagccgcactacctggtcgatccatgcccaccaccaatggatgacaacagaagacatgttatcagtgtggaatagggtttggatagaggaaaacccatggatggaagacaaaactcatgtatccagttgggaagaagttccatacctagggaaaagggaagatcaatggtgtggatccctgataggtttgacagcgagggccacctgggccactaacatacaagtagccataaaccaagtgagaaggctcatcgggaatgagaattatctagattatatgacatcaatgaagagattcaagaatgagagtgatcccgaaggggcactctggtaa

SEQ ID NO: 5646 - RNA, 9879 nt, synthetic construct
  misc_feature 1..9879: note = derived and/or modified CDS sequence (wt) from DENV-1__EU660390__SS-prME
  source 1..9879: mol_type = other RNA
tctgtgactatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggtgagcaccgacgagacaaacgttccgtcgcactggccccacacgtgggacttggtttggaaacaagaaccgaaacgtggatgtcctccgaaggcgcttggaaacagatacaaagagtggagacttgggccctgagacatccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagtttaagtgtgtgacaaaactggaaggaaagatagtccaatatgaaaacttgaaatattcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccccttttcgacccaagatgagaaaggagtaacccagaatgggagattgataacagccaaccccatagtcactgacaaagaaaaaccagtcaacattgaggcagaaccgccttttggtgagagttacatcgtgataggagcaggtgagaaagctttgaaactaagttggttcaagaaaggaagcagcatagggaaaatgtttgaggcaactgccagaggagcacgaaggatggccatactgggagacaccgcatgggactttggttccataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtctctttcgatgacgtgcattgcagttggcctagtaacgctatacttaggagtcatggttcaggcggattcaggatgtgtaattaactggaaaggtagagaactcaaatgtggaagtggcatttttgttaccaatgaagttcatacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaactcacagtgattgtaggagatgttgctgggatcttgggccaaggaagaaaaatgattaggccacaacccatggaatataaatactcgtggaaaagctggggaaaggctaaaatcataggggcagatgcacagaacaccaccttcatcatcgacggcccaaacaccccggaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatcccacactctatggagcaatggagttctggaaagtgaaatgataattccaaagatctatggaggaccaatatctcaacacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcctccgacaggatggggatgggaacgacgtatctagctctgatggccacttttaaaatgagaccaatgtttgctgtggggctgctattccgcagactaacatccagagaagttcttcttctaacaattggattgagtctagtggcatctgtggagttaccaaattccttggaggagctaggggatggacttgcaatgggcattatgattttaaaattgttgactgactttcaatcacatcagctgtgggctaccttgctgtccttgacatttatcaaaacaacattttccttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatttggggaaggaaaagttggcccctcaatgaaggaatcatggctgttggaatagtcagcatcctactaagttcactcctcaaaaatgatgtgccgctagctgggccactagtagctggaggcatgctaatagcatgttatgttatatctggaagctcagccgatctatcactagagaaagcggctgaggtctcctgggaagaagaagcagagcactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggtaggtcccaagtaggggtaggagtttttcaagaaaacgtgttccacacaatgtggcatgtcaccaggggagctgtactcatgtatcaagggaagagactagaaccgagctgggccagtgtcaaaaaagacctgatctcatatggaggaggttggaggcttcgaggatcctggaacacgggagaagaagtgcaggtgattgctgttgaaccagggaaaaaccccaaaaatgtacaaacggcgccgggcacctttaagacccctgaaggcgaagttggagccattgctctagattttaaacccggcacatctggatctcccatcgtgaacagagaaggaaaaatagtaggtctttatggaaacggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagtcgacctcatgtgtcacgccactttcaccatgcgcctcctgtctcccgtgagagttcccaattacaacatgattatcatggatgaagcacattttacagatccatccagcatagcggccagagggtacatctcaactcgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcaccgacttcccaggcaaaacagtttggtttgttccaagcattaaatcaggaaatgacattgccaactgcttaagaaagaatgggaagcgggtgattcaattgagcaggaaaacctttgacacagagtaccaaaaaacaaaaaataacgactgggactacgtcgtcacaacagacatctccgaaatgggagcgaatttccgggccgacagggtgatagacccaagacggtgtctgaaaccggtaatactaaaggatggtccagagcgtgtcattttagcaggaccgatgccagtgactgtggccagtgccgcccagaggagaggaagaattggaaggaaccacaataaggaaggtgatcagtacatctacatgggacagcctttaaacaatgatgaagatcacgctcactggacggaagcaaaaatgctccttgataatataaacacaccagaagggattatcccagccctcttcgagccggagagagaaaagagtgcagcagtagacggggaatacagactgcgaggtgaagcaaggaaaacgtttgtggagctcatgagaagaggagatctacctgtctggctatcctacaaagttgcttcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatttaatattagaaatagggaaacttccacaacacttgacgcaaagggcccagaatgccttggacaacctggttatgctgcacaattccgaacaaggaggaagagcctatagacatgcaatggaagaactgccagacaccatagaaacgttaatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacagcaaacatttccctgacagccattgcaaaccaggcagctatattgatgggacttgacaaaggatggccaatatcgaagatggacataggagttccacttctcgctttggggtgctattcccaggtgaatccactgacgctgacagcggcggtattgatgctagtggcccattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatttagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaggtcacagaagtgaagggatatacaaaaggaggacctggacatgaagaaccaatcccgatggcgacctatggatggaacctagtaaagctgcactccgggaaagacgtattcttcataccacctgagaaatgtgacacccttttgtgtgatattggtgagtcctctccaaacccaactatagaggaaggaagaacgctacgcgtcctaaagatggtggagccatggctcagaggaaaccaattctgcataaaaattctgaatccctacatgccaagtgtggtggaaactctggagcaaatgcaaagaaaacatggaggaatgctagtgcgaaatccactttcaagaaattctacccatgaaatgtattgggtttcatgtggaacaggaaacattgtgtcagcagtaaacatgacatccagaatgttgctaaatcgattcacaatggctcacaggaaaccaacgtatgaaagagacgtggacctaggcaccggaacaagacatgtggcagtggaaccagaggtagccaacctagatattattggccagaggatagagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttgggcaacagagggtgtttaaagagaaagttgacacacgcacaccaaaagcaaaacgaggtacagcacaaatcatggaggtgacagccaggtggttatggggttttctttctagaaacaagaaaccaagaatttgtacaagagaggagttcacaagaaaagttaggtcaaacgcagccatcggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagtttggaaaggcaaaaggaagtcgtgcaatatggtacatgtggttgggagcacgttttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgttatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagctctcgattggctggaaaaatatggcgtcgaaaggctaaaaagaatggcaatcagtggagatgattgcgtagtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgaaaccaagatgaacttgtgggtagggctagagtatcacaaggtgctggatggagcctgagagaaactgcatgcctaggcaaatcatatgcacaaatgtggcagctgatgtacttccacaggagagacctgagactagccgctaatgctatctgttcagccgttccagttgattgggtcccaactagccgcaccacctggtcgatccatgcccatcaccaatggatgacaacagaagacatgctgtcagtgtggaatagggtttggatagaggaaaacccatggatggaggacaaaacccatatatccagctgggaagatgttccatatttagggaaaagggaagatcaatggtgtggatccctgataggcttaacagcaagggccacctgggccaccaacatacaagtggctataaaccaagtgagaagactaattgggaatgagaattatctagactacatgacatcaatgaagagattcaagaacgagagtgatcccgaaggggcactctggtga

SEQ ID NO: 5647 - RNA, 9879 nt, synthetic construct
  misc_feature 1..9879: note = derived and/or modified CDS sequence (wt) from DENV-1__EU660391__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggtctagtaacattgtacctaggagttatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccactttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagatgggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgccttctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaagacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagatttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctaacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaatatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagccctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttgggaagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 5648 - RNA, 9879 nt, synthetic construct
  misc_feature 1..9879: note = derived and/or modified CDS sequence (wt) from DENV-1__EU660393__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcctggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgccgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaattcaaacgtccggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggaataacccagagtgggagattgataacagctaaccccatagttactgacaaagaaaaaccagtcaacattgaggcagaaccgccctttggtgagagttacatcataataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggtccaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaagctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggcaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcggctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtcatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgactctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctatagaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgttgacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccaggcgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactggccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5649 - RNA, 9879 nt, synthetic construct
  misc_feature 1..9879: note = derived and/or modified CDS sequence (wt) from DENV-1__EU660401__SS-prME
  source 1..9879: mol_type = other RNA
tctgtgaccatgctccttatgctaatgcctacagccttggcgttccatttgaccacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactatgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaattggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaattttcgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcataataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggtccaggcggattcaggatgtgtaattaattggaaaggtagagaactcaaatgtggaagtggcatttttgtcaccaatgaagtccacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcccacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctatccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgaccgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaataaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgttctgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgagacacacaatcgaaaacacaacggcaaatatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactggccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagggtgatcccgaaggggcactctggtga

SEQ ID NO: 5650 - RNA, 9879 nt, synthetic construct
  misc_feature 1..9879: note = derived and/or modified CDS sequence (wt) from DENV-1__FJ373305__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaattggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatcccttttttgacccaagatgaaaaaggagtaacccagaatgggagattgataacagctaaccccatagttactgacaaagaaaaaccagtcaacattgaggcagaaccgccctttggtgagagttacatcataataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggtccaggcggattcaggatgtgtaattaattggaaaggtagagaactcaaatgtggaagtggcatttttgtcaccaatgaagtccacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgatatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataataatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctatccttgacatttatcaaaacaacggtttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggccgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagttcaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagctatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgaccgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgttctgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgagacacacaatcgaaaacacaacggcaaatatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagtcaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactggccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagggtgatcccgaaggggcactctggtga

SEQ ID NO: 5651 - RNA, 9879 nt, synthetic construct
  misc_feature 1..9879: note = derived and/or modified CDS sequence (wt) from DENV-1__EU660402__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaaggaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaagccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacacaggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaatagatgcaccatgcaagatccctttttcgacccaagatgaaaaaggagtaacccagaatgggagactaataacagccaaccctatagtcactgacaaagaaaaaccagtcaatattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttccataggaggagtgttcacgtctgtcggaaaattagtacaccagatctttggaactgcatatggagtcttgttcagcggtgtttcctggaccatgaaaataggaataggagttctgctgacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggaaggtgtgtgtggaatacgatcagcaactcgtctcgagaacatcatgtggaagcaaatatcaaatgaactgaaccacatcttacttgaaaatgacatgaaactcacagtggttgtaggagatgttgctggaatcttggctcaagggaaaaaaatgattaggccacaacccatggaatacaaatactcgtggaaaatctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctagaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggatagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttacgacaggatggggatgggaacgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattttgaaattattgactgactttcaatcacatcagttgtgggctaccttgctgtccttgacatttatcagaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgacggaaccatgaagataaaggatgaagagagagatgacacgctaaccattctccttaaagcaactctgctagcagtttcaggggtgtacccattatcaataccagcaaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgttctcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaacccaaaaaatgtacaaacagcgccgggcacctttaagacctctgaaggtgaagttggagccattgccctagatttcaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaggctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgatcatcatggatgaagcacatttcaccgatccatccagcatagcggccagagggtacatctcaacccgagtgggcatgggtgaggcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcaattgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgaccgtggccagtgccgcccagaggagaggaagaattggaaggaaccacaataaggaaggtgatcagtacatctacatgggacagcctttaaacaacgatgaagatcatgctcactggacagaagcaaaaatgctccttgacaatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcccacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagagcccagaatgccttggacaatctggttatgttgcacaactccgaacaaggaggaagagcctatagacatgcaatggaagaactgccagacaccatagaaacgttgatgctcctagctttgatagctgtgttaactggtggagtgatgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggatcggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagtaagtcagaattcaacacttataaaaggagtgggatcatggaagtggacaggtccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattcttcataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatccagaatgttgctaaaccgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaacccatataaaacatgggcctaccatggatcatatgaggtcaagccgtcaggatcagcctcatccatggtcaatggcgtggtgaaactgctcaccaaaccatgggatgtcatccccatggtcacacaaatagccatgactgacaccacaccctttggacaacagagggtgttcaaagagaaagttgacacacgcacaccaaaagcaaaacgaggcacagcacaaattatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgctacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatacatactcagagacatatcaaagattccagggggaaacatgtatgcagatgacacagccggatgggacacaaggataacagaggatgaccttcagaacgaggccaaaattactgacatcatggaacccgaacatgccctactggctaagtcaatcttcaagttaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaacgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatgtatccagttggggagatgttccatatttaggaaaaagggaagatcaatggtgtggatccctgataggcttaacagcaagggccacctgggccaccaacatacaagtggccataaaccaagtgagaagactacttgggaatgagaattatctagattacatgacatcaatgaagagattcaagaatgagagtgatcctgaaggggcactctggtga

SEQ ID NO: 5652 - RNA, 9879 nt, synthetic construct
  misc_feature 1..9879: note = derived and/or modified CDS sequence (wt) from DENV-1__EU660403__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagatacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaattggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatcccttttttgacccaagatgaaaaaggagtaacccagaatgggagattgataacagctaaccccatagttactgacaaagaaaaaccagtcaacattgaggcagaaccgccctttggtgagagttacatcataataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggtccaggcggattcaggatgtgtaattaattggaaaggtagagaactcaaatgtggaagtggcatttttgtcaccaatgaagtccacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataataatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctatccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaatactggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgaccgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgttctgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgagacacacaatcgaaaacacaacggcaaatatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaattatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaagaataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactggccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagggtgatcccgaaggggcactctggtga

SEQ ID NO: 5653 - RNA, 9879 nt, synthetic construct
  misc_feature 1..9879: note = derived and/or modified CDS sequence (wt) from DENV-1__EU660397__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacccagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaagagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagagcactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctctgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaacagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5654 - RNA, 9879 nt, synthetic construct
  misc_feature 1..9879: note = derived and/or modified CDS sequence (wt) from DENV-1__EU687247__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcagaaccagatgacgttgattgttggtgcaatgccacagacacatgggtgacctatggaacatgttcccaaactggcgagcaccgacgagacaaacgttccgtcgcactggccccacacgtgggacttggtttggaaacaaggaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaagccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacacaggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggctatactgggagacaccgcatgggactttggttccataggaggagtgttcacgtctgtcggaaaattagtacaccagatctttggaactgcatatggagtcttgttcagcggtgtttcctggaccatgaaaataggaataggagttctgctgacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggaaggtgtgtgtggaatacgatcagcaactcgtctcgagaacatcatgtggaagcaaatatcaaatgaactgaaccacatcttacttgaaaatgacatgaaactcacagtggttgtaggagatgttgctggaatcttggctcaaggaaaaaaaatgattaggccacaacccatggaatacaaatactcgtggaaaatctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccgtctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggatagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattttgaaattattgactgactttcaatcacatcagttgtgggctaccttgctgtccttgacatttatcagaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcaaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgttctcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaacccaaaaaatgtacaaacagcgccgggcacctttaagacctctgaaggtgaagttggagccattgccctagatttcaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaggctgcgcacattaattctggctcccacaagggttgtcgcttccgaaatggcagaggcgctcaagggaatgccaataaggtaccaaacaacagcagtgaagagtgaacacacaggaaaggagatagttgacctcatgtgtcacgccactttcactatgcgcctcctgtctcccgtgagagttcccaattacaacatgatcatcatggatgaagcacatttcaccgatccatccagcatagcggccagagggtacatctcaacccgagtgggcatgggtgaggcagctgcgatcttcatgacagctactcccccaggatcagtggaggcctttccacagagcaacgcagttatccaagatgaggaaagagacattcccgagagatcatggaactcaggctatgagtggatcactgacttcccaggtaaaacagtttggtttgttccaagcatcaaatcaggaaatgacattgccaactgcttaagaaagaatgggaaacgggtgattcaattgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgacaatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagagcccagaatgccttggacaatctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggatcggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagtaagtcagaattcaacacttataaaaggagtgggatcatggaagtggacaggtccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagttacagaagtgaagggatatacaaaaggaggacctggacatgaggagccaattccaatggcgacctatggatggaacctagtaaaactgcactccgggaaagacgtattcttcataccacccgagaaatgtgacacccttttgtgtgatatcggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatccagaatgttgctaaaccgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaacccatataaaacatgggcctaccatggatcatatgaggtcaagccgtcaggatcagcctcatccatggtcaatggcgtggtgaaactgctcaccaaaccatgggatgtcatccccatggtcacacaaatagccatgactgacaccacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagttaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcaactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatgtatccagttggggagatgttccatatttaggaaaaagggaagatcaatggtgtggatccctgataggcttaacagcaagggccacctgggccaccaacatacaagtggccataaaccaagtgagaagactacttgggaatgagaattatctagattacatgacatcaatgaagagattcaagaatgagagtgatcctgaaggggcactctggtga

SEQ ID NO: 5655 - RNA, 9879 nt, synthetic construct
  misc_feature 1..9879: note = derived and/or modified CDS sequence (wt) from DENV-1__EU660412__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagtttaagtgtgtgacaaaactggaaggaaagatagtccaatatgaaaacttgaaatactcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgctgttgacaatgaaagaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaggtggctgagacccagcatggaaccgttctagtgcagattaaatacgaaggaacagatgcaccatgcaagatccccttttcgacccaagatgagaaaggagtaacccagaatgggagattgataacagccaaccccatagtcactgacaaagaaaaaccagttaacattgaggcagaaccgccttttggtgagagttacatcgtgataggagcaggtgaaaaagctttgaagctaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagtcggcctagtaacgctatacttaggagtcatggttcaggcggattcaggatgtgtaattaactggaaaggtagagaactcaaatgtggaagtggcatttttgttaccaatgaagttcatacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaactcacagtggttgtaggagatgttgctgggatcttgggccaagggaaaaaaatgattaggccacaacccatggaatataaatactcgtggaaaagctggggaaaggctaaaatcataggggcagatgcacagaacaccaccttcatcatcgacggcccaaacaccccggaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattgtgcatcatggttggagccaacgcctccgacaggatggggatgggaacgacgtatctagctctgatggccacttttaaaatgagaccaatgtttgctgtggggctgctattccgcagactaacatccagagaagttcttcttctaacaattggattgagtctagtggcatctgtggagttaccaaattccttggaggagctgggggatggacttgcaatgggcattatgattttaaaattgttgactgactttcaatcacatcagctgtgggctaccttgctgtccttgacatttatcaaaacaacattttctttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatttggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatactagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcgaggatcctggaacacgggagaagaagtgcaggtgattgctgttgaaccagggaaaaaccccaaaaatgtacaaacggcgccgggcacctttaagacccctgaaggcgaagttggagccattgctctagattttaaacccggcacatctggatctcccatcgtgaacagagaaggaaaaatagtaggtctttatggaaatggagtagtgacaacaagtggaacctacgttagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacattttacagatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcaccgacttcccaggcaaaacagtttggtttgttccaagcattaaatcaggaaatgacattgccaactgcttaagaaagaatgggaagcgggtgattcaattgagcaggaaaacctttgacacagagtaccaaaaaacaaaaaataacgactgggactacgtcgtcacaacagacatctccgaaatgggagcgaatttccgggccgacagggtgatagacccaagacggtgtctgaaaccggtaatactaaaggatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcagtagacggggaatacagactgcgaggtgaagcaaggaaaacgtttgtggagctcatgagaagaggagatctacctgtctggctatcctacaaagttgcttcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggttatgctgcacaattccgaacaaggaggaagagcctatagacatgcaatggaagaactgccagacaccatagaaacgttaatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacagcaaacatttccctgacagccattgcaaaccaggcagctatattgatgggacttgacaaaggatggccaatatcgaagatggacataggggttccacttctcgctttggggtgctattcccaggtgaatccactgacgctgacagcggcggtattgatgctagtggcccattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatttagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatctgaagccaaagagggattgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaggtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcctctccaaacccaactatagaggaaggaagaacgctacgcgtcctaaagatggtggagccatggctcagaggaaaccaattctgcataaaaattctgaatccctacatgccaagtgtggtggaagctctggagcaaatgcaaagaaaacatggaggaatgctagtgcgaaatccactttcaagaaattctacccatgaaatgtattgggtttcatgtggaacaggaaacattgtgtcagcagtaaacatgacatccagaatgttgctaaatcgattcacaatggctcacaggaaaccaacatatgaaagagacgtggacctaggcaccggaacaagacatgtggcagtggaaccagaggtagccaacctagatattattggccagaggatagagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttgggcaacagagggtgtttaaagagaaagttgacacacgcacaccaaaagcaaaacgaggtacagcacaaatcatggaggtgacagccaggtggttatggggttttctttctagaaacaagaaaccaagaatttgtacaagagaggagttcacaagaaaagttaggtcaaacgcagccatcggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagtttggaaaggcaaaaggaagtcgtgcaatatggtacatgtggttgggagcacgttttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgttatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagctctcgattggctggaaaaatatggcgtcgaaaggctaaaaagaatggcaatcagtggagatgattgcgtagtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacaggagagacctaagactagccgctaatgctatctgttcagccgttccagttgattgggtcccaactagccgcaccacctggtcgatccatgcccatcaccaatggatgacaacagaagacatgctgtcagtgtggaatagggtttggatagaggaaaacccatggatggaggacaaaacccatatatccagctgggaagatgttccatatttagggaaaagggaagatcaatggtgtggatccctgataggcttaacagcaagggccacctgggccaccaacatacaagtggctataaaccaagtgagaagactaattgggaatgagaattatctagattacatgatatcaatgaagagattcaagaacgagagtgatcccgaaggggcactctggtga

SEQ ID NO: 5656 - RNA, 9879 nt, synthetic construct
  misc_feature 1..9879: note = derived and/or modified CDS sequence (wt) from DENV-1__EU660418__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatctttgtcaccaatgaagtccacacttggacagagcaatacaaatttcaagctgactccccaaagagactatcagcagccatcgggaaggcatgggaggagggtgtgtgtggaattagatcagcaactcgtctcgagaacatcatgtggaagcaaatatcaaatgaactgaatcacatcttacttgaaaatgatatgaaattcacagtggttgtaggagatgttgctgggattttggctcaaggaaagaaaatgatcaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaagatgaagagagagatgacacgctaaccattctccttaaagcaactctgttagcagtttcaggggtgtacccattatcaataccagcgaccctcttcgtgtggcacttttggcagaaaaagaaacagagatctggagtgttatgggacacacccagccctccagaagtgggaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactattcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggatgtagacttacatccagcttcagcctggaccctctatgcagtggccacaacaattattactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataagaggagtggaattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaacattccagggggaaacatgtatgcagatgacacagccggatgggatacaaggataacagaggatgaccttcagaatgaggccagaattactgacatcatggaacctgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgattgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagctggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5657 - RNA, 9879 nt, synthetic construct
  misc_feature 1..9879: note = derived and/or modified CDS sequence (wt) from DENV-1__EU677151__SS-prME
  source 1..9879: mol_type = other RNA
tctgtgaccatgctccttatgctgatacctacagccttggcattccatttgactacacgaggaggagagccgcacatgatagttagcaagcaggaaagaggaaagtcacttttgttcaagacctcagcaggtgttaacatgtgcaccctcatagcgatggatttgggagagttatgtgaggacacaatgacttacaaatgtcctcgaattactgaggtggaaccagatgacgttgattgttggtgcaataccacagacacatgggtgacctatggaacatgttcccaaactggcgagcaccgacgagacaagcgttccgtcgcactggccccacacgtgggacttggtttagaaacaagagccgaaacgtggatgtcctctgaaggcgcttggaaacagatacaaaaagtggagacttgggctctgagacacccaggattcacggtgatagccctttttctagcacatgccataggaacatccatcacccagaaagggattattttcattctgttaatgctggtgacaccttccatggccatgcgatgcgtgggaataggcagcagggacttcgtggaaggactgtcaggagcaacttgggtagatgtggtactggaacatggaagctgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacattggtggaagaacaagacgcgaactttgtgtgccgacgaacgtttgtggacagaggctggggcaatggctgtgggctcttcggaaaaggaagtctgataacgtgtgctaagttcaagtgtgtgacaaaactggaaggaaagatagttcaatatgaaaatttgaaatattcagtaatagtcaccgtccacactggagaccagcaccaggtgggaaatgagagcacagaacatgggacaactgcaactataacacctcaagctcctacgtcggaaatacagctgaccgactacggagctcttacattggactgctcacctagaacaggactagactttaatgagatggtgttgttgacaatgaaagaaaaatcatggctagtccacaaacaatggtttctagacctaccattgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtccggaacgacaacaatttttgcaggacacctgaaatgtagactaaagatggacaaactgactctaaaagggatgtcatatgtgatgtgcacaggttcattcaagctagagaaagaagtggctgagacccagcatggaaccgttttagtgcagattaaatacgaaggaacagatgcaccatgcaagatccccttttcgacccaagatgaaaaaggagtaacccagaacgggagattgataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatattgggagacaccgcatgggactttggttctataggaggagtgttcacgtctgttggaaaactagtacaccagatttttggaactgcatatggagttttgttcagcggtgtttcctggaccatgaaaataggaataggggttctgctgacatggctaggattaaactcaaggagcacgtccctttcgatgacgtgcattgcagttggtctagtaacactatacctaggagtcatggttcaggcggattcaggatgtgtgattaattggaagggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccacccgtctcgagaatatcatgtggaggcaaatatcaaatgaactgaaccacatcttacttgaaaatgacatgaaattcacagtagttgtaggagatgttgttgggatcttggctcaaggaaaaaagatgattaggccacaacccatggaacacaaatactcgtggaaaagctggggaaaagctaaaatcataggggcagatgtacagaacaccaccttcatcatcgatggcccaaacaccccagaatgccctgatgatcaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgatatggggtactggatagaaagtgaaaagaatgagacctggaagctggcaagagcctcttttatagaagttaaaacatgtatctggccaaaatcccacaccctatggagcaatggagttctggaaagtgaaatgataattccaaaaatctatggaggaccaatatctcagcacaactacagaccaggatatttcacacaaacggcagggccgtggcacctaggcaagttggaactggattttgatttatgtgagggtaccacagttgttgtggatgaacattgtggaaatcgaggagcatctcttagaaccacaacagtcacaggaaagataattcatgaatggtgttgcagatcttgcacgctaccacccttacgtttcaaaggagaagatgggtgttggtacggtatggaaatcagaccagtcaaggaaaaggaagagaatctagtcaaatcaatggtctcagcagggtcaggggaagtggacagcttttcactaggactgttatgcatatcaataatgatcgaagaggtgatgagatccagatggagtagaaaaatgctgatgactggaacactggctgtgttcttccttctcataatgggacaattgacatggaatgatctgatcaggtcatgcatcatggttggagccaacgcttccgacaggatggggatgggaacgacgtacctagctttgatggccacttttaaaatgagaccaatggttgctgtcgggctattattccgcagactaacatccagagaagttcttcttctaacaattggattgagtctagtggcatctgtggagttaccaaattccttggaggagctgggggatggacttgcaatgggcattatgattttaaaattattgactgactttcagtcatatcagctgtgggctaccttgctgtccttgacatttatcaaaacaacgttttccttgcactatgcatggaagacaatggctatggtactgtcaattgtatctctcctccccttatgcctgtccacgacctcccaaaaaacaacatggctcccggtgctattgggatctcttggatgcaaaccactaaccatgtttcttatagcagaaaacaaaatctggggaaggaaaagttggcccctcaatgaaggaatcatggctgttggcatagtcagcatcctactaagttcactcctcaaaaatgatgtgccgctagctgggccactaatagctggaggcatgctaatagcatgttatgttatatcaggaagctcagccgacctatcactagagaaagcggctgaggtttcttgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaggggaagagactggaaccgagttgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcaccttcaagacccctgaaggtgaagttggagccattgccttagatttcaaacccggcacatctggatctcctatcgtgaacagagaagggaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcgggaaaaacaagaagatatcttccagccatagtccgtgaggccataaaaaggaagctgcgcacactaattttggctcccacaagggttgtcgcttccgaaatggcagaggcgctcaaggggatgccaataaggtaccaaacaacagcagtgaagagtgaacacacaggaagagagatagttgatcttatgtgtcacgccactttcaccatgcgtctcctgtctcctgtgagagttcccaattacaacatgattatcatggatgaagcacatttcaccgatccatccagcatagcggccagaggatacatctcaacccgagtgggcatgggtgaagcagctgcgatcttcatgacagccactcccccaggatcggtggaagcctttccacagagcaatgcagtaatccaagatgaggaaagagacattcctgaaagatcatggaactcaggctatgagtggatcactgacttcccaggtaaaacagtttggtttgttccaagcatcaaatcaggaaatgacattgccaactgcctaagaaagaatgggaaacgggtgattcaattgagcaggaaaacctttgatacagagtaccaaaaaacaaaaaataacgactgggactacgtcgttacaacagacatctccgaaatgggagcaaacttccgggccgacagggtgatagacccaagacggtgtctgaaaccggtaatactaaaagatggtccagagcgtgtcatcttagcaggaccgatgccagtgactgtggccagtgccgcccagaggagaggaagaattggaaggaaccacaataaggaaggtgatcagtacatctacatgggacagcccttaaacaacgatgaagatcacgcccactggacagaagcaaaaatgctccttgataatataaacacaccagaagggattatcccagccctcttcgaaccggagagagaaaagagtgcagcaatagacggggaatacagactgcggggtgaagcaaggaaaacgtttgtggagctcatgagaagaggagatctacctgtctggttatcctacaaagttgcctcagaaggcttccagtactccgacagaagatggtgctttgacggggaaaggaacaaccaggtgttggaggagaacatggacgtggagatctggacaaaagaaggagaaagaaagaaactacgaccccgctggctagatgccagaacatactcagacccactggccctgcgcgagtttaaagagtttgcagcaggaagaagaagcgtctcaggtgatttaatattagagatagggaaacttccacaacacttgacgcaaagggcccagaatgccttggacaacctggtcatgttgcacaactccgaacaaggaggaagagcctatagacatgcaatggaagaactgccagacactatagaaacgttgatgctcctagctttgatagctgtgttgactggtggagtgacgctgttcttcctatcaggaaggggcctagggaaaacatctatcggcctactctgcgtgatggcttcaagcgcactgctatggatggccagtgtggagccccattggatagcggcctccatcatactggagttcttcttgatggtgctgcttattccagagccagacagacaacgcactccgcaagacaaccagctggcatatgtggtgataggtttgttattcatgatacttacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagccatattgatgggacttgacaaaggatggccaatatcgaagatggacataggagttccacttctagccttggggtgctattcccaagtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctaaccacgctttgggagggatctccaggaaaattctggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctacaaaaggagtgggataatggaagtggacagatccgaagccaaagagggactaagaagaggagaaacaaccaaacatgcagtgtcgagaggaaccgccaaactgaggtggtttgtggagaggaatcttgtgaaaccagaagggaaagtcatagacctcggttgtggaagaggtggttggtcatattattgcgctgggctgaagaaagtcacagaagtgaagggatacacaaaaggaggacccggacatgaggaaccaatcccaatggcgacctatggatggaacctagtaaagctgcactccgggaaagacgtattctttataccacctgagaaatgtgacacccttttgtgtgatattggtgaatcctctccaaacccaactatagaggaaggaagaacgttacgcgtcctaaagatggtggaaccatggctcagaggaaaccaattctgcataaagattctgaatccctacatgccaagtgtggtggaaaccctggaacaaatgcaaagaaaacatggaggaatgctagtgcgcaatccactttcaagaaattctacccatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaacaagacatgtggcagtggaaccagaggtagccaatctggatatcattggccagaggatagagaacataaaacatgaacacaagtcaacatggcattatgatgaggacaatccatataaaacatgggcctatcatggatcatatgaggtcaagccatcaggatcagcctcatccatggttaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcactgcacaaatcatggaggtgacagccaggtggttatggggctttctttccagaaacaaaaaaccaagaatttgtacaagagaggagttcacaagaaaagttaggtcaaacgcagccattggagcagtgttcgttgatgaaaatcaatggaactcagcaaaagaagcggtggaagatgaacggttctgggaccttgtgcacagagagagggagcttcacaaacagggaaaatgcgccacgtgtgtttacaacatgatggggaagagagagaaaaagctaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaactcggatacatactcagagacatatcaaagattcctgggggaaatatgtatgcagatgacacagccggatgggatacaaggataacagaggatgaccttcagaatgaggccaaaattactgacatcatggagcctgaacatgccctactggctacatcaatcttcaagctgacctaccaaaataaggtggtaagggtacagagaccagcaagaaatggaaccgtgatggatgtcatatccagacgtgaccagagaggaagtggccaggtcggaacttatggcttaaacactttcaccaacatggaagcccagctaataagacaaatggagtctgagggaatcttttcacccagcgagttggagaccccaaatttagccgagagagttctcgactggctggaaaaacatggcgtcgaaaggctaaaaagaatggcaatcagcggagatgactgcgtggtgaaaccaattgatgacaggtttgcaacagccttatcagctctgaatgatatgggaaaagtaagaaaagatataccacaatgggaaccctcaaaaggatggaatgattggcaacaagtgcctttttgttcacaccacttccaccagctgattatgaaggatggaagggaaatagtggtgccatgccgcaaccaagatgaacttgtgggtagggctagagtatcacaaggtgctggatggagcctgagagaaactgcatgtctaggcaagtcatatgcacaaatgtggcaactgatgtacttccacaggagagacctgagactagccgctaatgctatctgttcagccgttccagttgattgggtcccaaccagccgtaccacctggtcgatccatgcccatcaccaatggatgacaacagaagacatgttgtcagtgtggaatagggtttggatagaggaaaacccatggatggaggacaaaacccatatatccagctggggagatgttccatatttaggaaaaagggaagatcagtggtgtggatccctgataggcttaacagcaagggccacctgggccaccaacatacaagtggccataaaccaagtgagaagactaattgggaatgagaattatttagattacatgacatcaatgaagagattcaagaacgagagtgatcccgaaggggcactctggtga

SEQ ID NO: 5658 - RNA, 9879 nt, synthetic construct
  misc_feature 1..9879: note = derived and/or modified CDS sequence (wt) from DENV-1__EU677152__SS-prME
  source 1..9879: mol_type = other RNA
tctgtgaccatgctccttatgttgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgatgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgtattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaagggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgcagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaactagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaactggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacattatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgcttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaaaacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcttgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggcaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagaccatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaattaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgctgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgcggctgttgaaaatcaccaccatgccgcaatgctggacgtagacttacatccagcttcagcctggaccctctatgcagtggccacaacaatcatcactcccatgatgaggcacacaatcgaaaacacaacggcaaacatttccctgacagccattgcaaaccaggcggccatattgatgggacttgacaaaggatggccaatatcaaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtagagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgatacccttctgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagatatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 5659 - RNA, 9879 nt, synthetic construct
  misc_feature 1..9879: note = derived and/or modified CDS sequence (wt) from DENV-1__EU677155__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgattcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacccagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatcgcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcctctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggccgaggtctcctgggaagaagaagcagaacactctggcacctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgatccaattgagcaggaaaacctttgatacagagtaccaaaaaacaaaaaacaacgactgggactacgtcgtcacaacagacatctcagaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctgggtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgcaggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5660 - RNA, 9879 nt, synthetic construct
  misc_feature 1..9879: note = derived and/or modified CDS sequence (wt) from DENV-1__EU677157__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgcttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactatggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactgagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatctttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacaggccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagcagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatcactcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcttactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgacccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaacctgaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaagatgaccttcagaatgaggccagaatcactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccaagagagttctcgactggctggaaaaatatggcgtcgaaaggctgaaaagaatggcaatcagcggagatgactgcgtagtgaaaccaattgatgataggtttgcaacagccttgacagctctgaatgacatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5661 - RNA, 9879 nt, synthetic construct
  misc_feature 1..9879: note = derived and/or modified CDS sequence (wt) from DENV-1__EU677158__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagatacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacattagtggaagaacaagacgcgaactttgtgtgtcgacgaacgtttgtggacagaggctggggcaatggctgtgggctcttcggaaaaggaagcctaataacgtgtgctaagttcaagtgtgtgacaaaattggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatcccttttttgacccaagatgaaaaaggagtaacccagaatgggagattgataacagctaaccccatagttactgacaaagaaaaaccagtcaacattgaggcagaaccgccctttggtgagagttacatcataataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggtccaggcggattcaggatgtgtaattaattggaaaggtagagaactcaaatgtggaagtggcatttttgtcaccaatgaagtccacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataataatcgaggaggtgatgagatccagatggagtagaaaaatgctgatgactggaacactggctgtgttcgtccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctatccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaatactggcccccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactatgtcgtcacaacagacatctccgaaatgggagcaaatttccgagccgacagggtgatagacccaagacggtgtctgaaaccggtaatactaaaagatggtccagagcgtgtcattttagcaggaccaatgccagtgaccgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgttctgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgagacacacaatcgaaaacacaacggcaaatatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaattatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaagactgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactggccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaatcaagtgagaagactaattgggaatgagaattatctagattacatgacatcaatgaagagattcaagaacgagggtgatcccgaaggggcactctggtga

SEQ ID NO: 5662 - RNA, 9879 nt, synthetic construct
  misc_feature 1..9879: note = derived and/or modified CDS sequence (wt) from DENV-1__EU677159__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgttcgtggacagaggctggggcaatggctgtgggctcttcggaaaaggaagcctaataacgtgtgctaagtttaagtgtgtgacaaaactggaaggaaagatagtccaatatgaaaacttgaaatactcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgctgttgacaatgaaagaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaggtggctgagacccagcatggaaccgttctagtgcagattaaatacgaaggaacagatgcaccatgcaagatccccttttcgacccaagatgagaaaggagtaacccagaatgggagattgataacagccaaccccatagtcactgacaaagaaaaaccagttaacattgaggcagaaccgccttttggtgagagttacatcgtgataggagcaggtgaaaaagctttgaagctaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagtcggcctagtaacgctatacttaggagtcatggttcaggcggattcaggatgtgtaattaactggaaaggtagagaactcaaatgtggaagtggcatttttgttaccaatgaagttcatacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaactcacagtggttgtaggagatgttgctgggatcttgggccaagggaaaaaaatgattaggccacaacccatggaatataaatactcgtggaaaagctggggaaaggctaaaatcataggggcagatgcacagaacaccaccttcatcatcgacggcccaaacaccccggaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattgtgcatcatggttggagccaacgcctccgacaggatggggatgggaacgacgtatctagctctgatggccacttttaaaatgagaccaatgtttgctgtggggctgctattccgcagactaacatccagagaagttcttcttctaacaattggattgagtctagtggcatctgtggagttaccaaattccttggaggagctgggggatggacttgcaatgggcattatgattttaaaattgttgactgactttcaatcacatcagctgtgggctaccttgctgtccttgacatttatcaaaacaacattttctttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatttggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatactagtggaggtccaagatgatggaaccatgaagataaaggatgaagagagagatgacacgctaaccattctccttaaagcaactctgctagcagtttcaggggtgtacccaatatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcgaggatcctggaacacgggagaagaagtgcaggtgattgctgttgaaccagggaaaaaccccaaaaatgtacaaacggcgccgggcacctttaagacccctgaaggcgaagttggagccattgctctagattttaaacccggcacatctggatctcccatcgtgaacagagaaggaaaaatagtaggtctttatggaaatggagtagtgacaacaagtggaacctacgttagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacattttacagatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcaccgacttcccaggcaaaacagtttggtttgttccaagcattaaatcaggaaatgacattgccaactgcttaagaaagaatgggaagcgggtgattcaattgagcaggaaaacctttgacacagagtaccaaaaaacaaaaaataacgactgggactacgtcgtcacaacagacatctctgaaatgggagcgaatttccgggccgacagggtgatagacccaagacggtgtctgaaaccggtaatactaaaggatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcagtagacggggaatacagactgcgaggtgaagcaaggaaaacgtttgtggagctcatgagaagaggagatctacctgtctggctatcctacaaagttgcttcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggttatgctgcacaattccgaacaaggaggaagagcctatagacatgcaatggaagaactgccagacaccatagaaacgttaatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacagcaaacatttccctgacagccattgcaaaccaggcagctatattgatgggacttgacaaaggatggccaatatcgaagatggacataggggttccacttctcgctttggggtgctattcccaggtgaatccactgacgctgacagcggcggtattgatgctagtggcccattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatttagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatctgaagccaaagagggattgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaggtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcctctccaaacccaactatagaggaaggaagaacgctacgcgtcctaaagatggtggagccatggctcagaggaaaccaattctgcataaaaattctgaatccctacatgccaagtgtggtggaagctctggagcaaatgcaaagaaaacatggaggaatgctagtgcgaaatccactttcaagaaattctacccatgaaatgtattgggtttcatgtggaacaggaaacattgtgtcagcagtaaacatgacatccagaatgttgctaaatcgattcacaatggctcacaggaaaccaacatatgaaagagacgtggacctaggcaccggaacaagacatgtggcagtggaaccagaggtagccaacctagatattattggccagaggatagagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttgggcaacagagggtgtttaaagagaaagttgacacacgcacaccaaaagcaaaacgaggtacagcacaaatcatggaggtgacagccaggtggttatggggttttctttctagaaacaagaaaccaagaatttgtacaagagaggagttcacaagaaaagttaggtcaaacgcagccatcggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagtttggaaaggcaaaaggaagtcgtgcaatatggtacatgtggttgggagcacgttttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgttatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagctctcgattggctgggaaaatatggcgtcgaaaggctaaaaagaatggcaatcagtggagatgattgcgtagtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacaggagagacctaagactagccgctaatgctatctgttcagccgttccagttgattgggtcccaactagccgcaccacctggtcgatccatgcccatcaccaatggatgacaacagaagacatgctgtcagtgtggaatagggtttggatagaggaaaacccatggatggaggacaaaacccatatatccagctgggaagatgttccatatttagggaaaagggaagatcaatggtgtggatccctgataggcttaacagcaagggccacctgggccaccaacatacaagtggctataaaccaagtgagaagactaattgggaatgagaattatctagattacatgatatcaatgaagagattcaagaacgagagtgatcccgaaggggcactctggtga

SEQ ID NO: 5663 - RNA, 9879 nt, synthetic construct
  misc_feature 1..9879: note = derived and/or modified CDS sequence (wt) from DENV-1__EU677160__SS-prME
  source 1..9879: mol_type = other RNA
tctgtgaccatgctccttatgctgatgcctacagccttggcgttccatttgactacacgagggggagagccgcacatgatagttagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttagtgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcattggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattgttccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagaccatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtagaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggagggtggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttgacaataatggacctacatccaggatcggggaaaacaagaagatatcttccagccatagtccgtgaggccataaaaaggaagctgcgcacattaattctggctcccacaagagttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattattatggatgaagcacatttcaccgatccatccagcatagcggccagagggtacatctcaacccgagtgggcatgggtgaagcagctgcgatctttatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtatatctacatgggacagcctttaaacaacgatgaagatcatgctcactggacagaagcaaaaatgctccttgataatataaacacaccagaagggattatcccagccctcttcgagccggagagagagaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacgtactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttagggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctctgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactctgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgacctccagaacgaggccaaaattactgacattatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccaggagagttcttgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagttgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaatcaagtgagaagactaattgggaatgagaattatctagattacatgacatcaatgaagagattcaagaacgagagtgatcctgaaggtgcactctggtga

SEQ ID NO: 5664 - RNA, 9879 nt, synthetic construct
  misc_feature 1..9879: note = derived and/or modified CDS sequence (wt) from DENV-1__EU677162__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggtagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggtaatggatgtgggctcttcggaaaaggaagcctaataacgtgtgctaagttcaagtgtgttacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacagtggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaattaagctggttcaagaaaggaagcagcatagggagaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagctgccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactagctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtacttcttctaacaattggattgagtctagtggcatctgtggagttaccaaattccttggaggagctgggggatggacttgcaatgggcattatgattttaaaattattgactgactttcaatcacatcagttgtgggctaccttgctatccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctgggggcatgctaatagcatgttatgttatatctggaagctcagccgacctatcactagagaaagcagctgaggtctcctgggaagaagaagcagaacactctggtgcctcacacaacatattagtggaagtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccttagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataacataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaactgttgatggaattgttgcaatagacttggatcctgtggtttatgatgcaaaatttgagaagcaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaaccatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacacaacaccttttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccgtgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagatttaagaacgagagtgaccctgaaggggcactctggtga

SEQ ID NO: 5665 - RNA, 9879 nt, synthetic construct
  misc_feature 1..9879: note = derived and/or modified CDS sequence (wt) from DENV-1__EU677164__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtaggacttggtttggaaacaagaacagaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatagccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgatcaccggctaatgtcagctgccatcaaggacagcaaggcagttcacgctgacatggggtactggatagaaagtgaaaagaacgagacctggaagctggcaagagcctccttcatagaagttaaaacatgtatctggccaaagtcccacactctatggagcaatggagttctggaaagtgaaatgataattccaaagaactatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgctcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacaacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaactatgaagataaaggatgaagagagagatgacacgctaaccactctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacctaacaataatggacctacatccaggatcggggaaaacaagaagatatcttccagccatagtccgtgaggccataaaaaggaagctgcgtacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcctccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaagcttccacaacacttgacgcaaagggcccagaacgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgttgacagcggcggtgttgatgctagtggctcattacgccataattggacctggactgcaagcaaaagctactagagaagctcaaaaaaggacagcggccggaataatgaagaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttacctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaggccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatctatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagtttacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgacctccagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaagagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagttagaagactaattgggaatgagaattatctagattacatgacatcaatgaagagattcaagaacgagagtgatcctgaaggggcactctggtga

SEQ ID NO: 5666 - RNA, 9879 nt, synthetic construct
  misc_feature 1..9879: note = derived and/or modified CDS sequence (wt) from DENV-1__EU677165__SS-prME
  source 1..9879: mol_type = other RNA
tctgtgaccatgctccttatgctgatgcctacagccttggcgttccatctgactacacgagggggagagccgcacatgatagtcagcaagcaggaaagaggaaagtcactcttgtttaagacctcagcaggtgttaacatgtgcacccttatagcgatggatttgggagagttatgtgaggacacaataacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggcaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacaccccaagctcctacgacggaaatacagctgaccgactacggagctcttacattggattgttcacccagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggtacgacaacaatttttgcaggacacttgaaatgcagactaaagatggacaaactgactctaagagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaacacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacggcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctctgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtctatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgctgtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtagaaactctggagcaaatgcaaagaaaacatgggggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttcttgctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5667 - RNA, 9879 nt, synthetic construct
  misc_feature 1..9879: note = derived and/or modified CDS sequence (wt) from DENV-1__EU677140__SS-prME
  source 1..9879: mol_type = other RNA
tctgtgaccatgctccttatgctgatgcctacagccttggcgttccatttgaccacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactatgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaattggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacccagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacgtttaagacagctcatgcaaagaagcaggaagtagtcgtactaggatcacaagaaggagcaatgcacactgcgttgaccggagcgacagaaatccaaacgtctggaacgacaacaattttcgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcataataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggtccaggcggattcaggatgtgtaattaattggaaaggtagagaactcaaatgtggaagtggcatttttgtcaccaatgaagtccacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgtcctgatgaccaaagagcatggaacatttgggaagttgaggactatggatttggaattttcacgacaaacatatggctgaaattgcgtgattcccacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctatccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaggaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgaccgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgatggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactatgcgtaatggcttcaagcgttttgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgagacacacaatcgaaaacacaacggcaaatatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggatagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctgaaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactggccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagggtgatcccgaaggggcactctggtga

SEQ ID NO: 5668 - RNA, 9879 nt, synthetic construct
  misc_feature 1..9879: note = derived and/or modified CDS sequence (wt) from DENV-1__EU677166__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacccagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcctctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggccgaggtctcctgggaagaagaagcagaacactctggcgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgatccaattgagcaggaaaacctttgatacagagtaccaaaaaacaaaaaacaacgactgggactacgtcgtcacaacagacatctcagaaatgggagcaaatttccgagccgacagggtgatagacccaagacggtgtctgaaaccggtaatactaaaagatggtccagagcgtgtcattttagcaggaccaatgccagtgactgtagccagtgccgcccagaggagaggaagaattggaaggaaccacaataaggaaggtgatcagtacatctacatgggacagcctttaaacaacgatgaagatcacgctcactggacagaagcaaaaatgctccttgataatataaatacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagttcgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggtcctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaatcctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaggtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatctagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgcaggatggagcctgagagaaactgcatgcctaggcaagtcatatgcacaaatgtggcagctgatgtacttccacaggagagacctgagactagccgctaatgctatctgttcagccgttccagttaattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5669 - RNA, 9879 nt, synthetic construct
  misc_feature 1..9879: note = derived and/or modified CDS sequence (wt) from DENV-1__EU677170__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgctaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacccagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactgtcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggatgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcctctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggccgaggtctcctgggaagaagaagcagaacactctggcgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgatccaattgagcaggaaaacctttgatacagagtaccaaaaaacaaaaaacaacgactgggactacgtcgtcacaacagacatctcagaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagaaagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaataaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaagaggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtctcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaggtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaattttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtgagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgcaggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5670 - RNA, 9879 nt, synthetic construct
  misc_feature 1..9879: note = derived and/or modified CDS sequence (wt) from DENV-1__EU677171__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcatcaagtgggaaatgaaagcacagaacatgggacaactgcaactataacacctcaagctcctacgacggaaatacagctgaccgactacggagctcttacattggattgttcacccagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcctctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggccgaggtctcctgggaagaagaagcagaacactctggcgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgatccaattgagcaggaaaacctttgatacagagtaccaaaaaacaaaaaacaacgactgggactacgtcgtcacaacagacatctcagaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcttgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggatgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaggtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgcaggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5671 - RNA, 9879 nt, synthetic construct
  misc_feature 1..9879: note = derived and/or modified CDS sequence (wt) from DENV-1__EU677172__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagttacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtgacccagaatgggagattgataacagctaaccccatagttactgacaaagaaaaaccagttaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgatcaggccacaacccatggaatacaaatactcgtggaaaagctggggaaaggctaaaatcataggggcagatgcacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcacaatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcactatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagctatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaacttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5672 - RNA, 9879 nt, synthetic construct
  misc_feature 1..9879: note = derived and/or modified CDS sequence (wt) from DENV-1__EU677173__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcactcttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggtgcttggaaacagatacaaagagtggagacttgggccctgagacacccaggattcacggtgatagccctttttttagcacatgccataggaacatccatcacccagaaggggattattttcattttgttaatgctggtaacaccatccatggccatgcgatgcgtgggaataggcagcagggacttcgtggaaggactgtcaggagcaacctgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggttgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacacgggacaactgcaactataacacctcaagctcccacgtcggaaatacaactgaccgactacggagctcttacattggattgctcacccagaacaggactagactttaatgaaatggtgttgttgacaatgaaagaaaaatcatggctagtccacaaacaatggtttctagacctaccactgccttggacttcaggagctacaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtaatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagactgataacagctaatcctatagtcactgacaaagaaaaaccagtcaacattgaggcagaaccaccttttggtgagagttacatcgtgataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaaatgtgtgaccaccggctaatgtcagctgccatcaaggacagcaaggcagttcatgctgacatggggtactggatagaaagtgaaaagaacgagacctggaagctggcaagagcctctttcatagaagttaaaacatgtatttggccaaaatcccacactctatggagcaacggagttctggaaagtgaaatgataattccaaagatctatggaggaccaatatctcagcacaactacagaccaggatatttcacacaaacggcagggccatggcacctaggtaagttggaactggattttgatttgtgtgagggtaccacagttgttgtggatgaacattgtggaaaccgaggaccatctcttagaaccacaacagtcacaggaaagataattcatgaatggtgttgcagatcttgtacgctaccacccttacgtttcaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgttgggctattattccgtagactaacatccagagaagttctccttcttacaattggattgagtctagtggcatctgtggagttaccaaattccttggaggagctgggggatggacttgcaatgggcattatgattttaaaattattgactgactttcagtcacatcagctgtgggctaccttgctgtccttgacatttattaaaacaacgctttccttacactatgcatggaaaacaatggctatggtactgtcaattgtatctctcttccccttatgcctgtccacgacctcccaaaaaacaacgtggcttccggtgctattgggatctcttggatgcaagccactaaccatgtttctcataacagaaaacaaaatctggggaaggaaaagttggcccctcaatgaaggaatcatggctgttggagtagtcagtatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcacacaatatattagtggaggtccaagatgatggaactatgaagataaaggatgaagagagagatgacacgctaaccattctcctcaaagcaactctgctagcagtttcaggggtgtacccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaatgtgttccacacaatgtggcatgtcaccaggggagctgtactcatgtaccaagggaagagactggaaccgagttgggccagtgtcaaaaaagacctgatctcatatggaggaggttggaggcttcaaggatcctggaacgcgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctacgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggtatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagctgacagagtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctctaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgttgagatctggacaaaggaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttgcatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgaccctgacagcggcggtattgatgctagtggctcattacgccataattggacctggactacaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaaatcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaatatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacataagtcaacatggcactatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttctagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagtttgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaacttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaactcgtgggtagggctagagtatcacaaggtgctggatggagcctgagagaaactgcatgcctaggcaagtcatatgcacaaatgtggcagctgatgtactttcacaggagagacctgagactagccgccaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagactacatgacatcaatgaagagattcaagaacgagggtgatcccgaaggggcactctggtga

SEQ ID NO: 5673 - RNA, 9879 nt, synthetic construct
  misc_feature 1..9879: note = derived and/or modified CDS sequence (wt) from DENV-1__EU726779__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaaaaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccttttcgatgacgtgcattgcagttggcctagtaacactatacctaggagtcatggttcaggcggattcaggatgtgtaataaattggaaaggtagagaactcaaatgtggaagtggcatctttgtcaccaatgaagtccacacttggacagagcaatacaaatttcaagctgactccccaaagagactatcagcagccatcgggaaggcatgggaggagggtgtgtgtggaattagatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgatcaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacgaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggactttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaagatgaagagagagatgacacgctaaccattctccttaaagcaactctgttagcagtttcaggggtgtacccattatcaataccagcgaccctcttcgtgtggtacttttggcagaaaaagaaacagagatctggagtgttatgggacacacccagccctccagaagtgggaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggatgtagacttacatccagcttcagcctggaccctctatgcagtggccacaacaattattactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataagaggagtggaattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaacattccagggggaaacatgtatgcagatgacacagccggatgggatacaaggataacagaggatgaccttcagaatgaggccagaattactgacatcatggaacctgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgattgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagctggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5674 - RNA, 9879 nt, synthetic construct
  misc_feature 1..9879: note = derived and/or modified CDS sequence (wt) from DENV-1__EU677176__SS-prME
  source 1..9879: mol_type = other RNA
tctgtgaccatgctccttatgctgatgcctacagccttggcattccatttgactacacgaggaggagagccgcacatgatagttagcaagcaggaaagaggaaagtcacttttgttcaagacctcagcaggtgttaacatgtgcaccctcatagcgatggatttgggagagttatgtgaggacacaatgacttacaaatgtcctcgaattactgaggtggaaccagatgacgttgattgttggtgcaataccacagacacatgggtgacctatggaacatgttcccaaactggcgagcaccgacgagacaagcgttccgtcgcactggccccacacgtgggacttggtttagaaacaagagccgaaacgtggatgtcctctgaaggcgcttggaaacagatacaaaaagtggagacttgggctctgagacacccaggattcacggtgatagccctttttctagcacatgccataggaacatccatcacccagaaagggattattttcattctgttaatgctggtgacaccttccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacattggtggaagaacaagacgcgaactttgtgtgccgacgaacgtttgtggacagaggctggggcaatggctgtgggctcttcggaaaaggaagtctgataacgtgtgctaagttcaagtgtgtgacaaaactggaaggaaagatagttcaatatgaaaatttgaaatattcagtaatagtcaccgtccacactggagaccagcaccaggtgggaaatgagagcacagaacatgggacaactgcaactataacacctcaagctcctacgtcggaaatacagctgaccgactacggagctcttacattggactgctcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtccggaacgacaacaatttttgcaggacacctgaaatgtagactaaagatggacaaactgactctaaaagggatgtcatatgtgatgtgcacaggtttattcaagctagagaaagaagtggctgagacccagcatggaaccgttttagtgcagattaaatacgaaggaacagatgcaccatgcaagatccccttttcgacccaagatgaaaaaggagtaacccagaacgggagattgataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatattgggagacaccgcatgggactttggttctataggaggagtgttcacgtctgttggaaaactagtacaccagatttttggaactgcatatggagttttgttcagcggtgtttcctggaccatgaaaataggaataggggttctgctgacatggctaggattaaactcaaggagcacgtccctttcgatgacgtgcattgcagttggtctagtaacactatacctaggagtcatggttcaggcggattcaggatgtgtgattaattggaagggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatccgatcagccacccgtctcgagaatatcatgtggaggcaaatatcaaatgaactgaaccacatcttacttgaaaatgacatgaaattcacagtagttgtaggagatgttgttgggatcttggctcaaggaaaaaagatgattaggccacaacccatggaacacaaatactcgtggaaaagctggggaaaagctaaaatcataggggcagatgtacagaacaccaccttcatcatcgatggcccaaacaccccagaatgccctgatgatcaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgatatggggtactggatagaaagtgaaaagaatgagacctggaagctggcaagagcctcttttatagaagttaaaacatgtatctggccaaaatcccacaccctatggagcaatggagttctggaaagtgaaatgataattccaaaaatctatggaggaccaatatctcagcacaactacagaccaggatatttcacacaaacggcagggccgtggcacctaggcaagttggaactggattttgatttatgtgagggtaccacagttgttgtggatgaacattgtggaaatcgaggaccatctcttagaaccacaacagtcacaggaaagataattcatgaatggtgttgcagatcttgcacgctaccacccttacgtttcaaaggagaagatgggtgttggtacggtatggaaatcagaccagtcaaggaaaaggaagagaatctagtcaaatcaatggtctcagcagggtcaggggaagtggacagcttttcactaggactgttatgcatatcaataatgatcgaagaggtgatgagatccagatggagtagaaaaatgctgatgactggaacactggctgtgttcttccttctcataatgggacaattgacatggaatgatctgatcaggtcatgcatcatggttggagccaacgcttccgacaggatggggatgggaacgacgtacctagctttgatggccacttttaaaatgagaccaatgtttgctgtcgggctattattccgcagactaacatccagagaagttcttcttctaacaattggattgagtctagtggcatctgtggagttaccaaattccttggaggagctgggggatggacttgcaatgggcattatgattttaaaattattgactgactttcagtcatatcagctgtgggctaccttgctgtccttgacatttatcaaaacaacgttttccttgcactatgcatggaagacaatggctatggtactgtcaattgtatctctcctccccttatgcctgtccacgacctcccaaaaaacaacatggctcccggtgctattgggatctcttggatgcaaaccactaaccatgtttcttatagcagaaaacaaaatctggggaaggaaaagttggcccctcaatgaaggaatcatggctgttggcatagtcagcatcctactaagttcactcctcaaaaatgatgtgccgctagctgggccactaatagctggaggcatgctaatagcatgttatgttatatcaggaagctcagccgacctatcactagagaaagcggctgaggtctcttgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccggaagtagaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcaccttcaagacccctgaaggtgaagttggagccattgccttagatttcaaacccggcacatctggatctcctatcgtgaacagagaagggaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcgggaaaaacaaaaagatatcttccagccatagtccgtgaggccataaaaaggaagctgcgcacactaattttggctcccacaagggttgtcgcttccgaaatggcagaggcgctcaaggggatgccaataaggtaccaaacaacagcagtgaagagtgaacacacaggaagagagatagttgatcttatgtgtcacgccactttcaccatgcgtctcctgtctcctgtgagagttcccaattataacatgattatcatggatgaagcacatttcaccgatccatccagcatagcggccagaggatacatctcaacccgagtgggcatgggtgaagcagctgcgatcttcatgacagccactcccccaggatcggtggaagcctttccacagagcaatgcagttatccaagatgaggaaagagacattcctgaaagatcatggaactcaggctatgagtggatcactgacttcccaggtaaaacagtttggtttgttccaagcatcaaatcaggaaatgacattgccaactgcctaagaaagaatgggaaacgggtgattcaattgagcaggaaaacttttgatacagagtaccaaaaaacaaaaaataacgactgggactacgtcgttacaacagacatctccgaaatgggagcaaacttccgggccgacagggtgatagacccaagacggtgtctgaaaccggtaatactaaaagatggtccagagcgtgtcatcctagcaggaccgatgccagtgactgtggccagtgccgcccagaggagaggaagaattggaaggaaccacaataaggaaggtgatcagtacatctacatgggacagcccttaaacaacgatgaagatcacgcccactggacagaagcaaaaatgctccttgacaatataaacacaccagaagggattatcccagccctcttcgaaccggagagagaaaagagtgcagcaatagacggggaatacagactgcggggtgaagcaaggaaaacgtttgtggagctcatgagaagaggagatctacctgtctggttatcctacaaagttgcctcagaaggcttccagtactccgacagaagatggtgctttgacggggaaaggaacaaccaggtgttggaggagaacatggacgtggagatctggacaaaagaaggagaaagaaagaaactacgaccccgctggctagatgccagaacatactcagacccactggctctgcgcgagtttaaagagtttgcagcaggaagaagaagcgtctcaggtgatttaatattagaaatagggaaacttccacaacacttgacgcaaagggcccagaatgccttggacaacctggtcatgttgcacaactccgaacaaggaggaagagcctatagacatgcaatggaagaactgccagacactatagaaacgttgatgctcctagctttgatagctgtgttgactggtggagtgacgctgttcttcctatcaggaaggggcctagggaaaacatctatcggcctactctgcgtgatggcttcaagcgcactgctatggatggccagtgtggagccccattggatagcggcctccatcatactggagttcttcttgatggtgctgcttattccagagccagacagacaacgcactccgcaagacaaccagctggcatatgtggtgataggtttgttattcatgatacttacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagccatattgatgggacttgacaaaggatggccaatatcgaagatggacataggagttccacttctagccttggggtgctattcccaagtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattctggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctacaaaaggagtgggataatggaagtggacagatccgaagccaaagagggactaagaagaggagaaacaaccaaacatgcagtgtcgagaggaaccgccaaactgaggtggtttgtggagaggaatcttgtgaaaccagaagggaaagtcatagaccttggttgtggaagaggtggctggtcatactattgcgctgggctgaagaaagtcacagaagtgaagggatacacaaaaggaggacccggacatgaagaaccaatcccaatggcgacctatggatggaacctagtaaagctgcactccgggaaagacgtattctttataccacctgagaaatgtgacacccttttgtgtgatattggtgaatcctctccaaacccaactatagaggaaggaagaacgttacgcgtcctaaagatggtggaaccatggctcagaggaaaccaattctgcataaagattctgaatccctacatgccaagtgtggtggaaaccctggaacaaatgcaaagaaaacatggaggaatgctagtgcgaaatccactttcaagaaattctacccatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaacaagacatgtggcagtggaaccagaggtagccaatctggatatcattggccagaggatagagaacataaaacatgaacacaagtcaacatggcattatgatgaggacaatccatataaaacatgggcctatcatggatcatatgaggtcaagccatcaggatcagcctcatccatggttaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcactgcacaaatcatggaggtgacagccaggtggttatggggctttctttccagaaacaaaaaaccaagaatttgtacaagagaggagttcacaagaaaagttaggtcaaacgcagccattggagcagtgttcgttgatgaaaatcaatggaactcagcaaaagaagcggtggaagatgaacggttctgggaccttgtgcacagagagagggagcttcacaaacagggaaaatgcgccacgtgtgtttacaacatgatggggaagagagagaaaaagctaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaactcggatacatactcagagacatatcaaagattcctgggggaaatatgtatgcagatgacacagccggatgggatacaaggataacagaggatgaccttcagaatgaggccaaaattactgacatcatggagcctgaacatgccctactggctacgtcaatcttcaagctgacctaccaaaataaggtggtaagggtacagagaccagcaagaaatggaaccgtgatggatgtcatatccagacgtgaccagagaggaagtggccaggtcggaacttatggcttaaacactttcaccaacatggaagcccagctaataagacaaatggagtctgagagaatcttttcacccagcgagttggagaccccaaatttagccgagagagttctcgactggctggaaaaacatggcgtcgaaaggctaaaaagaatggcaatcagcggagatgactgcgtggtgaaaccaattgatgacaggtttgcaacagccttatcagctctgaatgatatgggaaaagtaagaaaagatataccacaatgggaaccctcaaaaggatggaatgattggcaacaagtgcctttttgttcacaccacttccaccagctgattatgaaggatggaagggaaatagtggtgccatgccgcaaccaagatgaacttgtgggtagggctagagtatcacaaggtgctggatggagcctgagagaaactgcatgtctaggcaagtcatatgcacaaatgtggcaactgatgtacttccacaggagagacctgagattagccgctaatgctatctgttcagccgttccagttgattgggtcccaaccagccgtaccacctggtcgatccatgcccatcaccaatggatgacaacagaagacatgttgtcagtgtggaatagggtttggatagaggaaaacccatggatggaggacaaaacccatatatccagctggggagatgttccatatttaggaaaaagggaagatcagtggtgtggatccctgataggcttaacagcaagggccacctgggccaccaacatacaagtggccataaaccaagtgagaagactaattgggaatgagaattatttagattacatgacatcaatgaagagattcaagaacgatagtgatcccgaaggggcactctggtga

SEQ ID NO: 5675 - RNA, 9879 nt, synthetic construct
  misc_feature 1..9879: note = derived and/or modified CDS sequence (wt) from DENV-1__EU726780__SS-prME
  source 1..9879: mol_type = other RNA
tctgtgaccatgctccttatgctgatgcctacagccttggcgttccatttgactacacgaggaggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctctttggaaaagggagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacccagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagataaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaaactttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctctcgatgacgtgcattgcagttggcctagtaacactatacctaggagtcatggttcaggcggattcaggatgtgtaataaattggaaaggtagagaactcaaatgtggaagtggcattttcgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccatcggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggtcaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcctctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggcgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaagcgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatatcagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccattatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggctggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccataaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcatcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcaatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5676 - RNA, 9879 nt, synthetic construct
  misc_feature 1..9879: note = derived and/or modified CDS sequence (wt) from DENV-1__EU726781__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaacagaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggggtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgtagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgatcaccggctaatgtcagctgccatcaaggacagcaaggcagttcacgctgacatggggtactggatagaaagtgaaaagaacgagacctggaagctggcaagagcctccttcatagaagttaaaacatgtatctggccaaagtcccacactctatggagcaatggagttctggaaagtgaaatgataattccaaagaactatggaggaccaatatctcaacacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgattcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgctcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacaacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacctaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgaccttatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcctccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaagcttccacaacacttgacgcaaagggcccagaacgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgttgacagcggcggtgttgatgctagtggctcattacgccataattggacctggactgcaagcaaaagctactagagaagctcaaaaaaggacagcggccggaataatgaagaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttacctagcaggagcaggtctggccttctcattaatgaaatctctaggaggaggtaggagaggcacgggagcccaaggggaaacactgggagagaaatggaaaagacagctgaaccaactgagtaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatctatggtcaatggcgtggtgaaactgctcaccaagccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagtttacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgacctccagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaagagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagttagaagactaattgggaatgagaattatctagattacatgacatcaatgaagagattcaagaacgagagtgatcctgaaggggcactctggtga

SEQ ID NO: 5677 - RNA, 9879 nt, synthetic construct
  misc_feature 1..9879: note = derived and/or modified CDS sequence (wt) from DENV-1__EU726782__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagatacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacattagtggaagaacaagacgcgaactttgtgtgtcgacgaacgtttgtggacagaggctggggcaatggctgtgggctcttcggaaaaggaagcctaataacgtgtgctaagttcaagtgtgtgacaaaattggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatcccttttttgacccaagatgaaaaaggagtaacccagaatgggagattgataacagctaaccccatagttactgacaaagaaaaaccagtcaacattgaggcagaaccgccctttggtgagagttacatcataataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggtccaggcggattcaggatgtgtaattaattggaaaggtagagaactcaaatgtggaagtggcatttttgtcaccaatgaagtccacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataataatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctatccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaatactggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactatgtcgtcacaacagacatctccgaaatgggagcaaatttccgagccgacagggtgatagacccaagacggtgtctgaaaccggtaatactaaaagatggtccagagcgtgtcattttagcaggaccaatgccagtgaccgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgttctgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgagacacacaatcgaaaacacaacggcaaatatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgactacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaattatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagatcccaaatttagccgagagagttctcgactggctggaaaaatatggcgtcgaaagactgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactggccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagggtgatcccgaaggggcactctggtga

SEQ ID NO: 5678 - RNA, 9879 nt, synthetic construct
  misc_feature 1..9879: note = derived and/or modified CDS sequence (wt) from DENV-1__EU677178__SS-prME
  source 1..9879: mol_type = other RNA
tctgtgaccatgctccttatgctgatgcctacagccttggcgttccatttgaccacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactatgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaattggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaattttcgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatcccttttttgacccaagatgaaaaaggagtaacccagaatgggagattgataacagctaaccccatagttactgacaaagaaaaaccagtcaacattgaggcagaaccgccctttggtgagagttacatcataataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggtccaggcggattcaggatgtgtaattaattggaaaggtagagaactcaaatgtggaagtggcatttttgtcaccaatgaagtccacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcccacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacacttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgttatccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgacgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacttgatctcatatggaggaggttggaggcttcaaggatcctggaacacaggagaagaagtgcaggtgattgctgttgaaccagggaaaaaccccaaaaacgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgaccgtggccagtgccgcccagaggagaggaagaattggaaggaaccacaataaggaaggtgatcagtacatctacatgggacagcctctaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgttctgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgagacacacaatcgaaaacacaacggcaaatatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagagatagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacacaacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatctttaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactggccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagggtgatcccgaaggggcactctggtga

SEQ ID NO: 5679 - RNA, 9879 nt, synthetic construct
  misc_feature 1..9879: note = derived and/or modified CDS sequence (wt) from DENV-1__EU687251__SS-prME
  source 1..9879: mol_type = other RNA
tctgtgaccatgctccttatgctgatgcctacagccttggcgttccatttgactacacgagggggggagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctagtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcatttaaactagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcataataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcccacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactacgcatggaagacaatggctatggtactgtcaatcgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggtacatctggatctcccatcgtgaacagagaagggaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgaccttatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatggcaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattattccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacattgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactaagcaagtcagaatttaacacctataaaaggagtgggatcatggaagtggacagatccgaagccaaagagggactgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatgggggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagatcccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctgaaaaaatatggcgtcgaaaggctgaaaagaatggcaatcagcggagatgactgcgtagtgaaaccaattgatgataggtttgcaacagccttgacagctctgaatgatatgggaaaagtgagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactggccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5680 - RNA, 9879 nt, synthetic construct
  misc_feature 1..9879: note = derived and/or modified CDS sequence (wt) from DENV-1__FJ024427__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccggctacggagctcttacattggattgttcacccagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggagcagatgcaccatgcaagatccctttttcgacccaagatgaaaaaggaataacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtaggaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcctctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggccgaggtctcctgggaagaagaagcagaacactctggcgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacacccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgatccaattgagcaggaaaacctttgatacagagtaccaaaaaacaaaaaacaacgactgggactacgtcgtcacaacagacatctcagaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattattccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctgtcaggaaggggcctagggaaaacatctattggcctactctgcgtaatggcttcaagcgtactgctatggatggccagtgtggagccccattggatagcggcctccatcatactggagttcttcttgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcaacagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaggtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgacaggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgcaggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatctagggaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5681 - RNA, 9879 nt, synthetic construct
  misc_feature 1..9879: note = derived and/or modified CDS sequence (wt) from DENV-1__FJ024428__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtaggacttggtttggaaacaagaaccgaaacgtggatgtcctctgaaggcgcttggaaacagatacaaagagtggagacttgggccttgagacacccaggattcacggtgacagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagacttcaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaacacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggtacactggctgtgttcttccttctcatagtgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttctactaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcagttgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaagaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagtcgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccaccggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggataatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgatcagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaagtatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagcggctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5682 - RNA, 9879 nt, synthetic construct
  misc_feature 1..9879: note = derived and/or modified CDS sequence (wt) from DENV-1__FJ024429__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtaggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagacttcaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgatgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaacacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaatagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggtacactggctgtgttcttccttctcatagtgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcagttgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcaaaaaaagaaacagagatctggggtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaagaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaagaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattaaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggataatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaagtatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5683 - RNA, 9879 nt, synthetic construct
  misc_feature 1..9879: note = derived and/or modified CDS sequence (wt) from DENV-1__FJ024430__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttctcaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattagatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgcttcttatagcagaaaacaaaatctggggaaggagaagttggcccctcaatgaaggaatcatggctgttggaatagtcagcatcctattaagttcactcctcaaaaatgatgtaccgctagctgggccactaatagctggaggcatgctaatagcatgttatgttatatctggaagctcagccgccctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtgggaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcagaaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggatgtagacttacatccagcttcagcctggaccctctatgcagtggccacaacaattatcactcccatgatgaggcacacaatcgaaaatacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataagaggagtggaattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaacattccagggggaaacatgtatgcagatgacacagccggatgggatacaaggataacagaggatgaccttcagaatgaggccagaattactgacatcatggaacctgaacatgccctactggctaagtcaatcttcaagctaacctaccaaaataaggtggtaagggtacagagaccaacaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccagttgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5684 - RNA, 9879 nt, synthetic construct
  misc_feature 1..9879: note = derived and/or modified CDS sequence (wt) from DENV-1__FJ024433__SS-prME
  source 1..9879: mol_type = other RNA
tctgtgaccatgctccttatgctgatgcctacagccttggcgttccatttgaccacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacgcctcaagctcctacgacggaaatacagctgaccgactacggagctcttacattggattgttcacccagaacaggactagactttaatgaaatggtgttgttgacaatgaaagaaaaatcatggctagtccacaaacaatggtttttagacctaccactgccttggacctcgggagcttcaatatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggtacgacaacaatttttgcaggacacttgaaatgcagactaaagatggacaaactgactctaagagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaacacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacggcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctctgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgctgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtagaaactctggagcaaatgcaaagaaaacatgggggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggaacctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttgggaagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5685 - RNA, 9879 nt, synthetic construct
  misc_feature 1..9879: note = derived and/or modified CDS sequence (wt) from DENV-1__FJ024434__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagtttaagtgtgtgacaaaactggaaggaaagatagtccaatatgaaaacttgaaatactcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgctgttgacaatgaaagaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaggtggctgagacccagcatggaaccgttctagtgcagattaaatacgaaggaacagatgcaccatgcaagatccccttttcgacccaagatgagaaaggagtaacccagaatgggagattgataacagccaaccccatagtcactgacaaagaaaaaccagttaacattgaggcagaaccgccttttggtgagagttacatcgtgataggagcaggtgaaaaagctttgaagctaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagtcggcctagtaacgctatacttaggagtcatggttcaggcggattcaggatgtgtaattaactggaaaggtagagaactcaaatgtggaagtggcatttttgttaccaatgaagttcatacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaactcacagtggttgtaggagatgttgctgggatcttgggccaagggaaaaaaatgattaggccacaacccatggaatataaatactcgtggaaaagctggggaaaggctaaaatcataggggcagatgcacagaacaccaccttcatcatcgacggcccaaacaccccggaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattgtgcatcatggttggagccaacgcctccgacaggatggggatgggaacgacgtatctagctctgatggccacttttaaaatgagaccaatgtttgctgtggggctgctattccgcagactaacatccagagaagttcttcttctaacaattggattgagtctagtggcatctgtggagttaccaaattccttggaggagctgggggatggacttgcaatgggcattatgattttaaaattgttgactgactttcaatcacatcagctgtgggctaccttgctgtctttgacatttatcaaaacaacattttctttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatttggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatactagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcgaggatcctggaacacgggagaagaagtgcaggtgattgctgttgaaccagggaaaaaccccaaaaatgtacaaacggcgccgggcacctttaagacccctgaaggcgaagttggagccattgctctagattttaaacccggcacatctggatctcccatcgtgaacagagaaggaaaaatagtaggtctttatggaaatggagtagtgacaacaagtggaacctacgttagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacattttacagatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcaccgacttcccaggcaaaacagtttggtttgttccaagcattaaatcaggaaatgacattgccaactgcttaagaaagaatgggaagcgggtgattcaattgagcaggaaaacctttgacacagagtaccaaaaaacaaaaaataacgactgggactacgtcgtcacaacagacatctccgaaatgggagcgaatttccgggccgacagggtgatagacccaagacggtgtctgaaaccggtaatactaaaggatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcagtagacggggaatacagactgcgaggtgaagcaaggaaaacgtttgtggagctcatgagaagaggagatctacctgtctggctatcctacaaagttgcttcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtataaagagtttgcagcaggaagaagaagcgtctcaggtgatctaatattagaaatagggaaacttccacaacacttgacgcaaagggcccagaatgccttggacaacctggttatgctgcacaattccgaacaaggaggaagagcctatagacatgcaatggaagaactgccagacaccatagaaacgttaatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacagcaaacatttccctgacagccattgcaaaccaggcagctatattgatgggacttgacaaaggatggccaatatcgaagatggacataggggttccactcctcgctttggggtgctattcccaggtgaatccactgacgctgacagcggcggtattgatgctagtggcccattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccgctggacctctgaccacgctttgggagggatctccaggaaaattttggaacaccacgatagcggtttccatggcaaacattttcagaggaagttatttagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatctgaagccaaagagggattgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaggtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcctctccaaacccaactatagaggaaggaagaacgctacgcgtcctaaagatggtggagccatggctcagaggaaaccaattctgcataaaaattctgaatccctacatgccaagtgtggtggaagctctggagcaaatgcaaagaaaacatggaggaatgctagtgcgaaatccactttcaagaaattctacccatgaaatgtattgggtttcatgtggaacaggaaacattgtgtcagcagtaaacatgacatccagaatgttgctaaatcgattcacaatggctcacaggaaaccaacatatgaaagagacgtggacctaggcaccggaacaagacatgtggcagtggaaccagaggtagccaacctagatattattggccagaggatagagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttgggcaacagagggtgtttaaagagaaagttgacacacgcacaccaaaagcaaaacgaggtacagcacaaatcatggaggtgacagccaggtggttatggggttttctttctagaaacaagaaaccaagaatttgtacaagagaggagttcacaagaaaagttaggtcaaacgcagccatcggagcagtgttcgttgatgaaaatcaatggaactcagcgaaagaagcagtggaagatgagcggttctgggaccttgtgcacagagagagggagcttcacaaacagggaaaatgtgccacgtgtgtttacaacatgatggggaagagagagaaaaaactaggagagtttggaaaggcaaaaggaagtcgtgcaatatggtacatgtggttgggagcacgttttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgttatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagctctcgattggctggaaaaatatggcgtcgaaaggctaaaaagaatggcaatcagtggagatgattgcgtagtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacaggagagacctaagactagccgctaatgctatctgttcagccgttccagttgattgggtcccaactagccgcaccacctggtcgatccatgcccatcaccaatggatgacaacagaagacatgctgtcagtgtggaatagggtttggatagaggaaaacccatggatggaggacaaaacccatatatccagctgggaagatgttccatatttagggaaaagggaagatcaatggtgtggatccctgataggcttaacagcaagggccacctgggccaccaacatacaagtggctataaaccaagtgagaagactaattgggaatgagaattatctagattacatgatatcaatgaagagattcaagaacgagagtgatcccgaaggggcactctggtga

SEQ ID NO: 5686 - RNA, 9879 nt, synthetic construct
  misc_feature 1..9879: note = derived and/or modified CDS sequence (wt) from DENV-1__FJ024435__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtaggacttggtttggaaacaagaaccgaaacgtggatgtcctctgaaggcgcttggaaacagatacaaagagtggagacttgggccttgagacacccaggattcacggtgacagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagacttcaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaacacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataatttatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggtacactggctgtgttcttccttctcatagtgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttctactaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcagttgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaagaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagtcgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggataatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaagtatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagacgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5687 - RNA, 9879 nt, synthetic construct
  misc_feature 1..9879: note = derived and/or modified CDS sequence (wt) from DENV-1__FJ024436__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagctttgtgaggacacaatgacttacaagtgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattatcttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtgatagtcaccgtccacactggagaccagcaccaggtgggaaatgaaagcacagaatacgggacaactgcaactataacacctcaagctccttcaacggaaatacagctgaccgactacggagctcttacattggattgttcacctagaacaggactagacttcaatgaaatggtgttgttgacaatgaaagaaaaatcatggctagtccacaaacaatggtttctagacctaccactgccttggacctcgggagcttcaacatcacaagagacttggaacagacaagatttgcttgtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacatgcattgcagttggcctagtaacattatacctaggagtcatggttcaggcggattcaggatgtgtaattaattggaaaggcagagaactcaaatgtggaagtggcatttttgtcaccaatgaagttcacacttggacagagcaatacaaatttcaagctgactccccaaagagactatcagctgccatcgggaaggcatgggatgagggtgtgtgtggaatacgatcagcaactcgtctcgagaacatcatgtggaagcaaatatcaaatgaactgaaccacatcttacttgaaaatgacatgaaattcacagtggtcgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctagcaagagcctctttcatagaagtcaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttaatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgttagctgtaggactattattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgtattccttgcactatgcatggaagacaatggccatggtactgtcaattgtatctctcttccccttatgcctgtccacgacctcccaaaaaacaacatggcttccggtgctattgggatctcttggatgcaaaccactaaccatgtttctcatagcagaaaacaaaatctggggaaggaaaagttggcccctcaatgagggaatcatggctgttggaatagtcagcattctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggctccaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcccctaccagagattgaaaacgaagtgtttaggaaaagaaacttaacaataatggacctacatccaggatcggggaaaacaagaagatatcttccagccatagtccgtgaggccataaaaaggaagttgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcactgatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcagttgagcagaaaaacttttgatacagagtaccaaaaaacaaaaaataacgactgggactacgtcgtcacaacagacatctctgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgctggaggagaacatggacgtggagatctggacaaaagaaggagaaagaaagaaactaagaccccgctggctggatgctagaacatactcagacccactggccctgcgcgagtttaaagagtttgcagcaggaagaaaaagcgtctcaggtgatctaatattagaaatagggaaacttccacaacacttgacgcaaagggcccagaatgccttggacaatctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcttagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggatgtagacttacatccagcttcagcctggaccctctatgcagtggccacaacaattatcactcccatgatgaggcacacaatcgaaaacacaacggcaaacatttccctgacagccattgcgaaccaggcggctatattaatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacactacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccagctgagcaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattcttcataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaatattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcataggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacaaatcatggaggtgacagccaagtggttatggggttttctctctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcgatctttaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaggtggccataaaccaagtgagaagactaattgggaatgagaattatctagattacatgacatcaatgaagagattcaagaacgagagtgatcctgaaggggcactctggtga

SEQ ID NO: 5688 - RNA, 9879 nt, synthetic construct
  misc_feature 1..9879: note = derived and/or modified CDS sequence (wt) from DENV-1__FJ024472__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggatcattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccgtcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacaggccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgatcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagttcgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatttcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataacataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctaaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaaaggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcataggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaatcactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttacggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5689 - RNA, 9879 nt, synthetic construct
  misc_feature 1..9879: note = derived and/or modified CDS sequence (wt) from DENV-1__FJ024439__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcataataggagcaggtgaaaaagctttgaaactaagctggttcaaaaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccttttcgatgacgtgcattgcagttggcctagtaacactatacctaggagtcatggttcaggcggattcaggatgtgtaataaattggaaaggtagagaactcaaatgtggaagtggcatctttgtcaccaatgaagtccacacttggacagagcaatacaaatttcaagctgactccccaaagagactatcagcagccatcgggaaggcatgggaggagggtgtgtgtggaattagatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgatcaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacgaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggactttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaagatgaagagagagatgacacgctaaccattctccttaaagcaactctgttagcagtttcaggggtgtacccattatcaataccagcgaccctcttcgtgtggtacttttggcagaaaaagaaacagagatctggagtgttatgggacacacccagccctccagaagtgggaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctacagacaagcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggatgtagacttacatccagcttcagcctggaccctctatgcagtggccacaacaattattactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataagaggagtggaattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaacattccagggggaaacatgtatgcagatgacacagccggatgggatacaaggataacagaggatgaccttcagaatgaggccagaattactgacatcatggaacctgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgattgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagctggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5690 - RNA, 9879 nt, synthetic construct
  misc_feature 1..9879: note = derived and/or modified CDS sequence (wt) from DENV-1__FJ024441__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttataaatgccctcgaatcactgaaactgaaccagatgacgttgattgttggtgtaatgccacagacacatgggtgacctatggaacatgttcccaaactggcgagcaccggcgagacaaacgttccgtcgcactggccccacacgtgggacttggtttggaaacaagaaccgaaacgtggatgtcctctgaaggcgcttggagacagatacaaagagtggagacttgggccctgagacacccagggttcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacagaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaattttcgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcacaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaattataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtgtctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactactatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattctttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccaggaaaaaaccccaaaaatgtacaaacagcgccgggcacctttaagacccctgaaggtgaagttggagccattgccctagactttaaacctggcacatctggatctcccatcgtgaacagagaaggaaagatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacttacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatatggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaattccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaataccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatatgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttgaacactttcaccaacatggaagcccagctgataagacaaatggagtctgagggaatcttctcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5691 - RNA, 9879 nt, synthetic construct
  misc_feature 1..9879: note = derived and/or modified CDS sequence (wt) from DENV-1__FJ024442__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttctcaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgttctgcgcaaactatgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaattggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgctcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcataataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacactatacctaggagtcatggtccaggcggattcaggatgtgtaattaattggaaaggtagagaactcaaatgtggaagtggcatttttgtcaccaatgaagtccacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaacgaactgaatcacatcctacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttaatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctatccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaagaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaaaggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaacttaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgaccgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgttctgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgagacacacaatcgaaaacacaacggcaaatatttccctaacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaatctagtaaagctgcactctgggaaagacgtattctttataccacctgagaaatgtgacacccttttgtgtgatattggtgagtcctctccaaacccaactatagaggaagggagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccaactgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactggccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagggtgatcccgaaggggcactctggtga

SEQ ID NO: 5692 - RNA, 9879 nt, synthetic construct
  misc_feature 1..9879: note = derived and/or modified CDS sequence (wt) from DENV-1__FJ373296__SS-prME
  source 1..9879: mol_type = other RNA
tctgtgaccatgctccttatgctgatgcctatagccttggcgttccatttgactacacgagggggagagccgcacatgatagtcagcaagcaggaaagaggaaagtcacttttgttcaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagtttaagtgtgtgacaaaactggaaggaaagatagtccaatatgaaaacttgaaatactcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccccttttcgacccaagatgagaaaggagcaacccagaatgggagattgataacagccaaccccatagtcactgacaaagaaaaaccagtcaacattgaggcagaaccgccttttggtgagagttacatcgtgataggagcaggtgaaaaagctttgaagctaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagtcggcctagtaacgctatacttaggagtcatggttcaggcggattcaggatgtgtaattaactggaaaggtagagaactcaaatgtggaagtggcatttttgttaccaatgaagttcatacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaactcacagtggttgtaggagatgttgctgggatcttgggccaaggaaaaaaaatgattaggccacaacccatggaatataaatactcgtggaaaagctggggaaaggctaaaatcataggggcagatgcacagaacaccaccttcatcatcgacggcccaaacaccccggaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcctccgacaggatggggatgggaacgacgtatctagctctgatggccacttttaaaatgagaccaatgtttgctgtggggctgctattccgcagactaacatccagagaagttcttcttctaacaattggattgagtctagtggcatctgtggagttaccaaattccttggaggagctgggggatggacttgcaatgggcattatgattttaaaattgttgactgactttcaatcacatcagctgtgggctaccttgctgtccttgacatttatcaaaacaacattttctttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatttggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcgaggatcctggaacacgggagaagaagtgcaggtgattgctgttgaaccagggaaaaaccccaaaaatgtacaaacggcgccgggcacctttaagacccctgaaggcgaagttggagccattgctctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgtacactaattctggctcccacaagggttgtcgcttctgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacattttacagatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcaccgacttcccaggcaaaacagtttggtttgttccaagcattaaatcaggaaatgacattgccaactgcctaagaaagaatgggaagcgggtgattcaattgagcaggaaaacctttgacacagagtaccaaaaaacaaaaaataacgactgggactacgtcgtcacaacagacatctccgaaatgggagcgaatttccgggccgacagggtgatagacccaagacggtgtctgaaaccggtaatactaaaggatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcagtagacggggaatatagactgcgaggtgaagcaaggaaaacgtttgtggagctcatgagaagaggagatctacctgtctggctatcctacaaagttgcttcagaaggcttccagtactctgacagaagatggtgctttgacggggaaaggaacaaccaagtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggttatgctgcacaattccgaacaaggaggaagagcctatagacatgcaatggaagaactgccagacaccatagaaacgttaatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacagcaaacatttccctgacagccattgcaaaccaggcagctatattgatgggacttgacaaaggatggccaatatcgaagatggacataggggttccacttctcgctttggggtgctattcccaggtgaatccactgacgctgacagcggcggtattgatgctagtggcccattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatttagcaggagcaggtctggccttctcattaatgaaatctctaggaggaggtaggagaggcacgggagcccaaggggaaacactgggagaaaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaggtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcctctccaaacccaactatagaggaaggaagaacgctacgcgtcctaaagatggtggagccatggctcagaggaaaccaattctgcataaaaattctgaatccctacatgccaagtgtggtggaaactctggagcaaatgcaaagaaaacatggaggaatgctagtgcgaaatccactttcaagaaattctacccatgaaatgtattgggtttcatgtggaacaggaaacattgtgtcagcagtaaacatgacatccagaatgttgctaaatcgattcacaatggctcacaggaaaccaacatatgaaagagacgtggacctaggcaccggaacaagacatgtggcagtggaaccagaggtagccaacctagatattattggccagaggatagagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacaccacaccctttgggcaacagagggtgtttaaagagaaagttgacacacgcacaccaaaagcaaaacgaggtacagcacaaatcatggaggtgacagccaggtggttatggggttttctttctagaaacaagaaaccaagaatttgtacaagagaggagttcacaagaaaagttaggtcaaacgcagccatcggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagtttggaaaggcaaaaggaagtcgtgcaatatggtacatgtggttgggagcacgttttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgttatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagctctcgattggctggaaaaatatggcgtcgaaaggctaaaaagaatggcaatcagtggagatgattgcgtagtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcaactgatgtacttccacaggagagacctaagactagccgctaatgctatctgttcagccgttccagttgattgggtcccaactagccgcaccacctggtcgatccatgcccatcaccaatggatgacaacagaagacatgctgtcagtgtggaatagggtttggatagaggaaaacccatggatggaggacaaaacccatatatccagctgggaagatgttccatatttagggaaaagggaagaccaatggtgtggatccctgataggcttaacagcaagggccacctgggccaccaacatacaagtggctataaaccaagtgagaagactaattgggaatgagaattatctagattacatgacatcaatgaagagattcaagaacgagagtgatcctgaaggggcactctggtga

SEQ ID NO: 5693 - RNA, 9879 nt, synthetic construct
  misc_feature 1..9879: note = derived and/or modified CDS sequence (wt) from DENV-1__FJ182018__SS-prME
  source 1..9879: mol_type = other RNA
tctgtgaccatgctccttatgctgatgcctacagccttggcgttccatttgaccacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactatgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaattggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaattttcgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcataataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggtccaggcggattcaggatgtgtaattaattggaaaggtagagaactcaaatgtggaagtggcatttttgtcaccaatgaagtccacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcccacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctatccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaggaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtacaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcaattatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgaccgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgttctgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgagacacacaatcgaaaacacaacggcaaatatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacactcttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggttaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactggccgctaatgctatttgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagggtgatcccgaaggggcactctggtga

SEQ ID NO: 5694 - RNA, 9879 nt, synthetic construct
  misc_feature 1..9879: note = derived and/or modified CDS sequence (wt) from DENV-1__FJ410287__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagatacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaattggaaggaaagatagttcaatatgagaacttgaaatattcagtaatagtcaccgttcacaccggagaccagcaccaagtgggaaatgaaagcacagaacatgggacaactgcaactataacatctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatcccttttttgacccaagatgaaaaaggagtaacccagaatgggagattgataacagctaaccccatagttactgacaaagaaaaaccagtcaacattgaggcagaaccgccctttggtgagagttacatcataataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggtccaggcggattcaggatgtgtaattaattggaaaggtagagaactcaaatgtggaagtggcatttttgtcaccaatgaagtccacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataataatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctatccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcatcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaatactggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgaccgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgttctgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgagacacacaatcgaaaacacaacggcaaatatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaattatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactggccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagggtgatcccgaaggggcactctggtga

SEQ ID NO: 5695 - RNA, 9879 nt, synthetic construct
  misc_feature 1..9879: note = derived and/or modified CDS sequence (wt) from DENV-1__FJ432719__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacggcggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtgacccagaatgggagattgataacagctaaccccatagttactgacaaagaaaaaccagttaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgatggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagctatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaattccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttttagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaacttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5696 - RNA, 9879 nt, synthetic construct
  misc_feature 1..9879: note = derived and/or modified CDS sequence (wt) from DENV-1__FJ182020__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgtgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactagctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtacttcttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaactatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagctcatgagaagaggagatctacctgtctggctatcctacaaagttgcctcagaaggctttcagtactctgacagaagatggtgctttgacggggaaaggaataaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctaacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaaccatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacacaacaccttttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 5697 - RNA, 9879 nt, synthetic construct
  misc_feature 1..9879: note = derived and/or modified CDS sequence (wt) from DENV-1__FJ182022__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacccagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggtacgacaacaatttttgcaggacacttgaaatgcagactaaagatggacaaactgactctaagagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaacacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacggcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctctgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtagaaactctggagcaaatgcaaagaaaacatgggggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5698 - RNA, 9879 nt, synthetic construct
  misc_feature 1..9879: note = derived and/or modified CDS sequence (wt) from DENV-1__FJ024447__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaagtagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagtccacacttggacagagcaatacaaatttcaagctgactccccaaagagactatcagcagccatcgggaaggcatgggaggagggtgtgtgtggaattagatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgatcaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgaccctcttcgtgtggtacttttggcagaaaaagaaacagagatctggagtgttatgggacacacccagccctccagaagtgggaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggatgtagacttacatccagcttcagcctggaccctctatgcagtggccacaacaattattactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataagaggagtggaattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaacattccagggggaaacatgtatgcagatgacacagccggatgggatacaaggataacagaggatgaccttcagaatgaggccagaattactgacatcatggaacctgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagctggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5699 - RNA, 9879 nt, synthetic construct
  misc_feature 1..9879: note = derived and/or modified CDS sequence (wt) from DENV-1__FJ182025__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttctcaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattagatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctattaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtgggaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctctctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagcttatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatagcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggatgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataagaggagtggaattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaacattccagggggaaacatgtatgcagatgacacagccggatgggatacaaggataacagaggatgacctccagaatgaggccagaattactgacatcatggaacctgaacatgccctactggctaagtcaatcttcaagctaacctaccaaaataaggtggtaagggtacagagaccaacaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccagttgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5700 - RNA, 9879 nt, synthetic construct
  misc_feature 1..9879: note = derived and/or modified CDS sequence (wt) from DENV-1__FJ373297__SS-prME
  source 1..9879: mol_type = other RNA
tctgtgaccatgctccttatgctgatgcctacagccttggcattccatttgactacacgaggaggagagccgcacatgatagttagcaagcaggaaagaggaaagtcacttttgttcaagacctcagcaggtgttaacatgtgcaccctcatagcgatggatttgggagagttatgtgaggacacaatgacttacaaatgtcctcgaattactgaggtggaaccagatgacgttgattgttggtgcaataccacagacacatgggtgacctatggaacatgttcccaaactggcgagcaccgacgagacaagcgttccgtcgcactggccccacacgtgggacttggtttagaaacaagggccgaaacgtggatgtcctctgaaggcgcttggaaacagatacaaaaagtggagacttgggctctgagacacccaggattcacggtgatagccctttttctagcacatgccataggaacatccatcacccagaaagggattattttcattctgttaatgctggtgacaccttccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacattggtggaagaacaagacgcgaactttgtgtgccgacgaacgtttgtggacagaggctggggcaatggctgtgggctcttcggaaaaggaagtctgataacgtgtgctaagttcaagtgtgtgacaaaactggaaggaaagatagttcaatatgaaaatttgaaatattcagtaatagtcaccgtccacactggagaccagcaccaggtgggaaatgagagcacagaacatgggacaactgcaactataacacctcaagctcctacgtcggaaatacagctgaccgactacggagctcttacattggactgctcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtccggaacgacaacaatttttgcaggacacctgaaatgtagactaaagatggacaaactgactctaaaagggatgtcatatgtgatgtgcacaggtttattcaagctagagaaagaagtggctgagacccagcatggaaccgttttagtgcagattaaatacgaaggaacagatgcaccatgcaagatccccttttcgacccaagatgaaaaaggagtaacccagaacgggagattgataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatattgggagacaccgcatgggactttggttctataggaggagtgttcacgtctgttggaaaactagtacaccagatttttggaactgcatatggagttttgttcagcggtgtttcctggaccatgaaaataggaataggggttctgctgacatggctaggattaaactcaaggagcacgtccctttcgatgacgtgcattgcagttggtctagtaacactatacctaggagtcatggttcaggcggattcaggatgtgtgattaattggaagggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatccgatcagccacccgtctcgagaatatcatgtggaggcaaatatcaaatgaactgaaccacatcttacttgaaaatgacatgaaattcacagtagttgtaggagatgttgttgggatcttggctcaaggaaaaaagatgattaggccacaacccatggaacacaaatactcgtggaaaagctggggaaaagctaaaatcataggggcagatgtacagaacaccaccttcatcatcgatggcccaaacaccccagaatgccctgatgatcaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgatatggggtactggatagaaagtgaaaagaatgagacctggaagctggcaagagcctcttttatagaagttaaaacatgtatctggccaaaatcccacaccctatggagcaatggagttctggaaagtgaaatgataattccaaaaatctatggaggaccaatatctcagcacaactacagaccaggatatttcacacaaacggcagggccgtggcacctaggcaagttggaactggattttgatttatgtgagggtaccacagttgttgtggatgaacattgtggaaatcgaggaccatctcttagaaccacaacagtcacaggaaagataattcatgaatggtgttgcagatcttgcacgctaccacccttacgtttcaaaggagaagatgggtgttggtacggtatggaaatcagaccagtcaaggaaaaggaagagaatctagtcaaatcaatggtctcagcagggtcaggggaagtggacagcttttcactaggactgttatgcatatcaataatgatcgaagaggtgatgagatccagatggagtagaaaaatgctgatgactggaacactggctgtgttcttccttctcataatgggacaattgacatggaatgatctgatcaggtcatgcatcatggttggagccaacgcttccgacaggatggggatgggaacgacgtacctagctttgatggccacttttaaaatgagaccaatgtttgctgtcgggctattattccgcagactaacatccagagaagttcttcttctaacaattggattgagtctagtggcatctgtggagttaccaaattccttggaggagctgggggatggacttgcaatgggcattatgattttaaaattattgactgactttcagtcatatcagctgtgggctaccttgctgtccttgacatttatcaaaacaacgttttccttgcactatgcatggaagacaatggctatggtactgtcaattgtatctctcctccccttatgcctgtccacgacctcccaaaaaacaacatggctcccggtgctattgggatctcttggatgcaaaccactaaccatgtttcttatagcagaaaacaaaatctggggaaggaaaagttggcccctcaatgaaggaatcatggctgttggcatagtcagcatcctactaagttcactcctcaaaaatgatgtgccgctagctgggccactaatagctggaggcatgctaatagcatgttatgttatatcaggaagctcagccgacctatcactagagaaagcggctgaggtctcttgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtagaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcaccttcaagacccctgaaggtgaagttggagccattgccttagatttcaaacccggcacatctggatctcctatcgtgaacagagaagggaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcgggaaaaacaagaagatatcttccagccatagtccgtgaggccataaaaaggaagctgcgcacactaattttggctcccacaagggttgtcgcttccgaaatggcagaggcgctcaaggggatgccaataaggtaccaaacaacagcagtgaagagtgaacacacaggaagagagatagttgatcttatgtgtcatgccactttcaccatgcgtctcctgtctcctgtgagagttcccaattataacatgattatcatggatgaagcacatttcaccgatccatccagcatagcggccagaggatacatctcaacccgagtgggcatgggtgaagcagctgcgatcttcatgacagccactcccccaggatcggtggaagcctttccacagagcaatgcagttatccaagatgaggaaagagacattcctgaaagatcatggaactcaggctatgagtggatcactgacttcccaggtaaaacagtttggtttgttccaagcatcaaatcaggaaatgacattgccaactgcctaagaaagaatgggaaacgggtgattcaattgagcaggaaaacttttgatacagagtaccaaaaaacaaaaaataacgactgggactacgtcgtcacaacagacatctccgaaatgggagcaaacttccgggccgacagggtgatagacccaagacggtgtctgaaaccggtaatactaaaagatggtccagagcgtgtcatcctagcaggaccgatgccagtgactgtggccagtgccgcccagaggagaggaagaattggaaggaaccacaataaggaaggtgatcagtacatctacatgggacagcccttaaacaacgatgaagatcacgcccactggacagaagcaaaaatgctccttgacaatataaacacaccagaagggattatcccagccctcttcgaaccggagagagaaaagagtgcagcaatagacggggaatacagactgcggggtgaagcaaggaaaacgtttgtggagctcatgagaagaggagatctacctgtctggttatcctacaaagttgcctcagaaggcttccagtactccgacagaagatggtgctttgacggggaaaggaacaaccaggtgttggaggagaacatggacgtggagatctggacaaaagaaggagaaagaaagaaactacgaccccgctggctagatgccagaacatactcagacccactggccctgcgcgagtttaaagagtttgcagcaggaagaagaagcgtctcaggtgatttaatattagaaatagggaaacttccacaacacttgacgcaaagggcccagaatgccttggacaacctggtcatgttgcacaactccgaacaaggaggaagagcctatagacatgcaatggaagaactgccagacactatagaaacgttgatgctcctagctttgatagctgtgttgactggtggagtgacgctgttcttcctatcaggaaggggcctagggaaaacatctatcggcctactctgcgtgatggcttcaagcgcactgctatggatggccagtgtggagccccattggatagcggcctccatcatactggagttcttcttgatggtgctgcttattccagagccagacagacaacgcactccgcaagacaaccagctggcatatgtggtgataggtttgttattcatgatacttacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagccatattgatgggacttgacaaaggatggccaatatcgaagatggacataggagttccacttctagccttggggtgctattcccaagtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattctggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctacaaaaggagtgggataatggaagtggacagatccgaagccaaagagggactaagaagaggagaaacaaccaaacatgcagtgtcgagaggaaccgccaaactgaggtggtttgtggagaggaatcttgtgaaaccagaagggaaagtcatagaccttggttgtggaagaggtggctggtcatactattgcgctgggctgaagaaagtcacagaagtgaagggatacacaaaaggaggacccggacatgaagaaccaatcccaatggcgacctatggatggaacctagtaaagctgcactccgggaaagacgtattctttataccacctgagaaatgtgacacccttttgtgtgatattggtgaatcctctccaaacccaactatagaggaaggaagaacgttacgcgtcctaaagatggtggaaccatggctcagaggaaaccaattctgcataaagattctgaatccctacatgccaagtgtggtggaaaccctggaacaaatgcaaagaaaacatggaggaatgctagtgcgaaatccactttcaagaaattctacccatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaacaagacatgtggcagtggaaccagaggtagccaatctggatatcattggccagaggatagagaacataaaacatgaacacaagtcaacatggcattatgatgaggacaatccatataaaacatgggcctatcatggatcatatgaggtcaagccatcaggatcagcctcatccatggttaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcactgcacaaatcatggaggtgacagccaggtggttatggggctttctttccagaaacaaaaaaccaagaatttgtacaagagaggagttcacaagaaaagttaggtcaaacgcagccattggagcagtgttcgttgatgaaaatcaatggaactcagcaaaagaagcggtggaagatgaacggttctgggaccttgtgcacagagagagggagcttcacaaacagggaaaatgcgccacgtgtgtttacaacatgatggggaagagagagaaaaagctaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaactcggatacatactcagagacatatcaaagattcctgggggaaatatgtatgcagatgacacagccggatgggatacaaggataacagaggatgaccttcagaatgaggccaaaattactgacatcatggagcctgaacatgccctactggctacgtcaatcttcaagctgacctaccaaaataaggtggtaagggtacagagaccagcaagaaatggaaccgtgatggatgtcatatccagacgtgaccagagaggaagtggccaggtcggaacttatggcttaaacactttcaccaacatggaagcccagctaataagacaaatggagtctgagggaatcttttcacccagcgagttggagaccccaaatttagccgagagagttctcgactggctggaaaaacatggcgtcgaaaggctaaaaagaatggcaatcagcggagatgactgcgtggtgaaaccaattgatgacaggtttgcaacagccttatcagctctgaatgatatgggaaaagtaagaaaagatataccacaatgggaaccctcaaaaggatggaatgattggcaacaagtgcctttttgttcacaccacttccaccagctgattatgaaggatggaagggaaatagtggtgccatgccgcaaccaagatgaacttgtgggtagggctagagtatcacaaggtgctggatggagcctgagagaaactgcatgtctaggcaagtcatatgcacaaatgtggcaactgatgtacttccacaggagagacctgagattagccgctaatgctatctgttcagccgttccagttgattgggtcccaaccaaccgtaccacctggtcgatccatgcccatcaccaatggatgacaacagaagacatgttgtcagtgtggaatagggtttggatagaggaaaacccatggatggaggacaaaacccatatatccagctggggagatgttccatatttaggaaaaagggaagatcagtggtgtggatccctgataggcttaacagcaagggccacctgggccaccaacatacaagtggccataaaccaagtgagaagactaattgggaatgagaattatttagattacatgacatcaatgaagagattcaagaacgatagtgatcccgaaggggcactctggtga

SEQ ID NO: 5701 - RNA, 9879 nt, synthetic construct
  misc_feature 1..9879: note = derived and/or modified CDS sequence (wt) from DENV-1__FJ024448__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaataacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacccagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggtacgacaacaatttttgcaggacacttgaaatgcagactaaagatggacaaactgactctaagagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaacacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacggcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagcttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctctgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtagaaactctggagcaaatgcaaagaaaacatgggggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5702 - RNA, 9879 nt, synthetic construct
  misc_feature 1..9879: note = derived and/or modified CDS sequence (wt) from DENV-1__FJ182026__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcaccctcatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaaaatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacgcaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttggggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcttcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgacatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5703 - RNA, 9879 nt, synthetic construct
  misc_feature 1..9879: note = derived and/or modified CDS sequence (wt) from DENV-1__FJ182027__SS-prME
  source 1..9879: mol_type = other RNA
tctgtgaccatgctccttatgctgatgcctacagccttggcgttccatctgactacacgagggggagagccgcacatgatagtcagcaagcaggaaagaggaaagtcactcttgtttaagacctcagcaggtgtcaacatgtgcacccttatagcgatggatttgggagagttatgtgaggacacaataacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacaccccaagctcctacgacggaaatacagctgaccgactacggagctcttacattggattgttcacccagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggtacgacaacaatttttgcaggacacttgaaatgcagactaaagatggacaaactgactctaagagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaacacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacggcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctctgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtagaaactctggagcaaatgcaaagaaaacatgggggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5704 - RNA, 9879 nt, synthetic construct
  misc_feature 1..9879: note = derived and/or modified CDS sequence (wt) from DENV-1__FJ024449__SS-prME
  source 1..9879: mol_type = other RNA
tctgtgaccatgctccttatgctgatgcctacagccttggcgttccatttgaccacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactatgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaattggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacgtttaagacagctcatgcaaagaagcaggaagtagtcgtactaggatcacaagaaggagcaatgcacactgcgttgaccggagcgacagaaatccaaacgtctggaacgacaacaattttcgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcataataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaagaagcacgtccctttcgatgacgtgcattgcagttggcctagtaacactatacctaggagtcatggtccaggcggattcaggatgtgtaattaattggaaaggtagagaactcaaatgtggaagtggcatttttgtcaccaatgaagtccacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggccaaaatcataggggcagatgtacagaacaccaccttcatcatcgatggcccaaacaccccagaatgtcctgatgaccaaagagcatggaacatttgggaagttgaggactatggatttggaattttcacgacaaacatatggctgaaattgcgtgattcccacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaattggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctatccttgacatttatcaaaacaacgttttccttgcactacgcatggaagacaatggctatggtactgtcaattgtatctctcttccctttatgcctgtccacgacctcccaaaaaacaacatggcttccagtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaggaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtgggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgaccgtggccagtgccgcccagaggagaggaagaattggaaggaaccacaataaggaaggtgatcagtacatctacatgggacagcctctaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgatggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgttttgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgagacacacaatcgaaaacacaacggcaaatatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcgacatggcattatgatgaggacaatccatataaaacatgggcctatcatggatcatatgatgtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgatcttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctgaaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactggccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagggtgatcccgaaggggcactctggtga

SEQ ID NO: 5705 - RNA, 9879 nt, synthetic construct
  misc_feature 1..9879: note = derived and/or modified CDS sequence (wt) from DENV-1__FJ390383__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagatacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacattagtggaagaacaagacgcgaactttgtgtgtcgacgaacgtttgtggacagaggctggggcaatggctgtgggctcttcggaaaaggaagcctaataacgtgtgctaagttcaagtgtgtgacaaaattggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatcccttttttgacccaagatgaaaaaggagtaacccagaatgggagattgataacagctaaccccatagttactgacaaagaaaaaccagtcaacattgaggcagaaccgccctttggtgagagttacatcataataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggtccaggcggattcaggatgtgtaattaattggaaaggtagagaactcaaatgtggaagtggcatttttgtcaccaatgaagtccacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataataatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctatccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgaaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaatactggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactatgtcgtcacaacagacatctccgaaatgggagcaaatttccgagccgacagggtgatagacccaagacggtgtctgaaaccggtaatactaaaagatggtccagagcgtgtcattttagcaggaccaatgccagtgaccgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgttctgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgagacacacaatcgaaaacacaacggcaaatatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaattatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagatcccaaatttagccgagagagttctcgactggctggaaaaatatggcgtcgaaagactgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactggccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagggtgatcccgaaggggcactctggtga

SEQ ID NO: 5706 - RNA, 9879 nt, synthetic construct
  misc_feature 1..9879: note = derived and/or modified CDS sequence (wt) from DENV-1__FJ182033__SS-prME
  source 1..9879: mol_type = other RNA
tctgtgaccatgctccttatgctgatgcctacagccttggcattccatttgactacacgaggaggagagccgcacatgatagttagcaagcaggaaagaggaaagtcacttttgttcaagacctcagcaggtgttaacatgtgcaccctcatagcgatggatctgggagagttatgtgaggacacaatgacttacaaatgtcctcgaattactgaggtggaaccagatgacgttgattgttggtgcaataccacagacacatgggtgacctatggaacatgttcccaaactggcgagcaccgacgagacaagcgttccgtcgcactggccccacacgtgggacttggtttagaaacaagagccgaaacgtggatgtcctctgaaggcgcttggaaacagatacaaaaagtggagacttgggctctgagacacccaggattcacggtgatagccctttttctagcacatgccataggaacatccatcacccagaaagggattattttcattctgttaatgctggtgacaccttccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagttacaaaccctgccgtcctgcgcaaactgtgcattgaagctaaaatatcaaacaccaccaccgactcaagatgtccaacacaaggagaagccacattggtggaagaacaagacgcgaactttgtgtgccgacgaacgtttgtggacagaggctggggcaatggctgtgggctcttcggaaaaggaagcctgataacgtgtgctaagttcaagtgtgtgacaaaactggaaggaaagatagttcaatatgaaaatttgaaatattcagtaatagtcaccgtccacactggagaccagcaccaggtgggaaatgagagcacagaacatgggacaactgcaaccataacacctcaagctcccacgtcggaaatacagctgaccgactacggagctcttacattggactgttcacctagaacaggactagactttaacgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtccggaacgacaacaatttttgcaggacacctgaaatgtagactaaagatggacaaactgactctaaaagggatgtcatatgtgatgtgcacaggttcattcaagctagagaaagaagtggctgagacccagcatggaaccgttttggtgcagattaaatacgaaggaacagatgcaccatgcaagatccctttttcgacccaagatgaaaaaggagtaacccagaacgggagattgataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatattgggagacaccgcatgggactttggttctataggaggagtgttcacgtctattggaaaactagtacaccagatttttggaactgcatatggagttttgttcagcggtgtttcctggaccatgaaaataggaataggggttctgctgacatggctaggattaaactcaaggagcacgtccctttcgatgacgtgcattgcagttggtctagtaacactatacctaggagtcatggttcaggcggattcaggatgtgtaattaattggaagggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccacccgtctcgagaatatcatgtggaggcaaatatcaaatgaactgaaccacatcttacttgaaaatgacatgaaattcacagtagttgtaggagatgttgttgggatcttggctcaaggaaaaaagatgattaggccacaacccatggaacacaaatactcgtggaaaagctggggaaaggctaaaatcataggggcagatgtacagaacaccaccttcatcatcgatggcccaaacaccccagaatgccctgatgatcaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgatatggggtactggatagaaagtgaaaagaatgagacctggaagctggcaagagcctcttttatagaagttaaaacatgtatctggccaaaatcccacaccctatggagcaatggagttctggaaagtgaaatgataattccaaaaatctatggaggaccaatatctcagcacaactacagaccaggatatttcacacaaacggcagggccgtggcacctaggcaagttggaactggattttgatttatgtgagggtaccacagttgttgtggatgaacattgtggaaatcgaggaccatctctcagaaccacaacagtcacaggaaagataattcatgaatggtgttgcagatcttgcacgctaccacccttacgtttcaaaggagaagatgggtgttggtacggtatggaaatcagaccagtcaaggaaaaggaagagaatctagtcaaatcaatggtctcagcagggtcaggggaagtggacagcttttcactaggactgttatgcatatcaataatgatcgaagaggtgatgagatccagatggagtagaaaaatgctgatgactggaacactggctgtgttcttccttctcataatgggacaattgacatggaatgatctgatcaggtcatgcatcatggttggagccaatgcttccgacaggatggggatgggaacgacgtacctagctttgatggccacttttaaaatgagaccaatgtttgctgtcgggctattattccgcagactaacatccagagaagttcttcttctaacaattggattgagtctagtggcatctgtggagttaccaaattccttggaggagctgggggatggacttgcaatgggcattatgattttaaaattattgactgactttcagtcatatcagctgtgggctaccttgctgtccttgacatttatcaaaacaacgttttccttgcactatgcatggaagacaatggctatggtactgtcaattgtatctctcctccccttatgcctgtccacgacctcccaaaaaacaacatggctcccggtgctattgggatctcttggatgcaaaccactaaccatgtttcttatagcagaaaacaaaatctggggaaggaaaagttggcccctcaatgaaggaatcatggctgttggcatagtcagcatcctactaagttcactcctcaaaaatgatgtgccgctagctgggccactaatagctggaggcatgctaatagcatgttatgttatatcaggaagctcagccgacctatcactagagaaagcggctgaggtctcttgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgccgttgaaccagggaaaaaccccaaaaatgtacaaacagcgccgggcaccttcaagacccctgaaggtgaagttggagccattgccttagatttcaaacccggcacatctggatctcctatcgtgaacagagaagggaaaatagtaggtctttatggaaatggagtagtgacaacaagtggaacctacgtcagtgccatagctcaagccaaagcatcacaagaagggcccctaccagagattgaagatgaagtgtttaggaaaagaaacttaacaataatggacctacatccaggatcggggaaaacaagaagatatcttccagccatagtccgtgaggccataaaaaggaagctgcgcacactaattttggctcccacaagggttgtcgcttccgaaatggcagaggcgctcaaggggatgccaataaggtaccaaacaacagcagtgaagagtgaacacacaggaagagagatagttgatcttatgtgtcacgccactttcaccatgcgtctcctgtctcctgtgagagttcccaattacaacatgattatcatggatgaagcacatttcaccgatccatccagcatagcggccagaggatacatctcaacccgagtgggcatgggtgaagcagctgcgatcttcatgacagccactcccccaggatcggtggaagcctttccacagagcaatgcagttatccaagatgaggaaagagacattcctgaaagatcatggaactcaggctatgagtggatcactgacttcccaggtaaaacagtttggtttgttccaagcatcaaatcaggaaatgacattgccaactgcctaagaaagaatgggaaacgggtgattcaattgagcaggaaaacctttgatacagagtaccaaaaaacaaaaaataacgactgggactacgtcgttacaacagacatctccgaaatgggagcaaacttccgggctgacagggtgatagacccaagacggtgtctgaaaccggtaatactaaaagatggtccagagcgtgtcatcttagcaggaccgatgccagtgactgtggccagtgccgcccagaggagaggaagaattggaaggaaccacaataaggaaggtgatcagtacatctacatgggacagcctttaaacaacgatgaagatcacgcccactggacagaagcaaaaatgctccttgataatataaacacaccagaagggattatcccagccctcttcgaaccggagagagaaaagagtgcagcaatagacggggaatacagactgcggggtgaagcaaggaaaacgtttgtggagctcatgagaagaggagatctacctgtctggttatcctacaaagttgcctcagaaggcttccagtactccgacagaagatggtgctttgacggggaaagaaacaaccaggtgttggaggagaacatggacgtggagatctggacaaaagaaggagaaagaaagaaactacgaccccgctggctagatgccagaacatactcagacccactggccctgcgcgagtttaaagagtttgcagctggaagaagaagcgtctcaggtgatttaatattagaaatagggaaacttccacaacacttgacgcaaagggcccagaatgccttggacaacctggtcatgttgcacaactccgaacaaggaggaagagcctatagacatgcaatggaagaactgccagacactatagaaacgttgatgctcctagctttgatagctgtgttgactggtggagtgacgctgttcttcctatcaggaaggggcctagggaaaacatctatcggcctactctgcgtgatggcttcaagcgcactgctatggatggccagtgtggagccccattggatagcggcctccatcatactggagttcttcttgatggtgctgcttattccagagccagacagacagcgcactccgcaagacaaccagctggcatatgtggtgataggtttgttattcatgatacttacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcatacaatcgaaaacacaacggcaaacatttccctgacagctattgcaaaccaggcagccatattgatgggacttgacaaaggatggccaatatcgaagatggacataggagttccacttctagccttggggtgctattcccaagtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgagaaacaactaggccaaataatgttgttgatactatgcacatcacagatcctcttgatgcggactacatgggccttgtgtgaatccatcacactggccactggacctctgaccacgctttgggagggatctccaggaaaattctggaacaccacgatagcggtttccatggcaaacattttcagaggaagttatctagcaggagcaggtctggccttctcattaatgaaatctctaggaggaggtaggagaggcacgggagcccaaggggaaacactgggagagaagtggaaaagacagctgaaccaactgagcaagtcagaattcaacacctacaaaaggagtgggataatggaagtggacagatccgaagccaaagagggactaagaagaggagaaacaaccaaacatgcagtgtcgagaggaaccgccaaactgaggtggtttgtggagaggaatcttgtgaaaccagaagggaaagtcatagacctcggttgtggaagaggtggctggtcatactattgcgctgggctgaagaaagtcacagaagtgaagggatacacaaaaggaggactcggacatgaggaaccaatcccaatggcgacctatggatggaacctagtaaagctgcactccgggaaagacgtattctttataccacctgagaaatgtgacacccttttgtgtgatattggtgaatcctctccaaacccaactatagaggaaggaagaacgttacgcgtcctaaagatggtggaaccatggctcagaggaaaccaattctgcataaagattctgaatccctacatgccaagtgtggtggaaaccctggaacaaatgcaaagaaaacatggaggaatgctagtgcgaaatccactttcaagaaattctacccatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaacaagacatgtggcagtggaaccagaggtagccaatctggatatcattggccagaggatagagaacataaaacatgaacacaagtcaacatggcattatgatgaggacaatccatataaaacatgggcctatcatggatcatatgaggtcaagccatcaggatcagcctcatccatggttaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcactgcacaaatcatggaggtgacagccaggtggttatggggctttctttccagaaacaaaaaaccaagaatttgtacaagagaggagttcacaagaaaagttaggtcaaacgcagccattggagcagtgttcgttgatgaaaatcaatggaactcagcaaaagaagcggtggaagatgagcggttctgggaccttgtgcacagagagagggagcttcacaaacagggaaaatgcgccacgtgtgtttacaacatgatggggaagagagagaaaaagctaggagagttcggaaaggcaaaaggaagtcgtgcaatatggtacatgtggctgggagcacgctttctagagttcgaagctcttggtttcatgaacgaagatcactggttcagtagagagaattcactcagcggagtggaaggagaaggactccacaaactcggatacatactcagagacatatcaaagattcctgggggaaatatgtatgcagatgacacagccggatgggatacaaggataacagaggatgaccttcagaatgaggccaaaattactgacatcatggagcctgaacatgccctactggctacgtcaatcttcaagctgacctaccaaaataaggtggtgagggtacagagaccagcaagaaatggaaccgtgatggatgtcatatccagacgtgaccagagaggaagtggccaggtcggaacttatggcttaaacactttcaccaacatggaagcccagctaataagacaaatggagtctgagggaatctttttacccagtgagttggagaccccaaatttagccgagagagttctcgactggctggaaaaacatggcgtcgaaaggctaaaaagaatggcaatcagcggagatgactgcgtggtgaaaccaattgatgacaggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatggaagggaaatagtggtgccatgccgcaaccaagatgaacttgtgggtagggctagagtatcacaaggtgctggatggagcctgagagaaactgcatgcctaggcaagtcatatgcacaaatgtggcaactgatgtacttccacaggagagacctgagactagccgctaatgctatctgttcagccgttccagttgattgggtcccaaccagccgtaccacctggtcgatccatgcccatcatcaatggatgacaacagaagacatgttgtcagtgtggaatagggtttggatagaggaaaacccatggatggaggacaaaacccatatatccagctggggagatgttccatatttaggaaaaagggaagatcagtggtgtggatccctgataggcttaacagcaagggccacctgggccaccaacatacaagtggccataaaccaagtgagaagactaattgggaatgagaattatttagattacatgacatcaatgaagagattcaagaacgagagtgatcccgaaggggcactctggtga

SEQ ID NO: 5707 - RNA, 9879 nt, synthetic construct
  misc_feature 1..9879: note = derived and/or modified CDS sequence (wt) from DENV-1__FJ182034__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagctttgtgaggacacaatgacttacaagtgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttttagcacatgccataggaacatccatcacccagaaagggattatcttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcagtatgaaaacttgaaatattcagtgatagtcaccgtccacactggagaccagcaccaggtgggaaatgaaagcacagaacacgggacaactgcaactataacacctcaagctccttcaacggaaatacagctgaccgactacggagctcttacattggattgttcacctagaacaggactagacttcaatgaaatggtgttgttgacaatgaaagaaaaatcatggctagtccacaaacaatggtttctagacctaccactgccttggacctcgggagcttcaacatcacaagagacttggaacagacaagatttgcttgtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacatgcattgcagttggcctagtaacattatacctaggagtcatggttcaggcggattcaggatgtgtaattaattggaaaggcagagaactcaaatgtggaagtggcatttttgtcaccaatgaagttcacacttggacagagcaatacaaatttcaagctgactccccaaagagactttcagctgccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggtcgtaggagatgttgctggaatcttggctcaaggaaaaaaaatgattaggccacaacccatggaatacaaatactcgtggaaaagctggggaaaggctaaaatcataggggcagatgtgcagaacaccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctagcaagagcctctttcatagaagtcaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttaatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaatgacgtacctagctctgatggccacttttaaaatgagaccaatgttagctgtaggactattattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgtattccttgcactatgcatggaagacaatggccatggtactgtcaattgtatctctcttccccttatgcctgtccacgacctcccaaaaaacaacatggcttccggtgctattgggatctcttggatgcaaaccactaaccatgtttctcatagcagaaaacaaaatctggggaaggaaaagttggcccctcaatgaaggaatcatggctgttggaatagtcagcattctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggctccaaggatcctggaacacaggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcccctaccagagattgaaaacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcagttgagcagaaaaacttttgatacagagtaccaaaaaacaaaaaataacgactgggactacgtcgtcacaacagacatctctgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgctggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcttagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggatgtagacttacatccagcttcagcctggaccctctatgcagtggccacaacaattatcactcccatgatgaggcacacaatcgaaaacacaacggcaaacatttccctgacagccattgcaaaccaggcggctatattaatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacactacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccagctgagcaagtcagaatttaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattcttcataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaatattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcataggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacaaatcatggaggtgacagccaagtggttatggggttttctctctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcgatctttaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaggtggccataaaccaagtgagaagactaattgggaatgagaattatctagattacatgacatcaatgaagagattcaagaacgagagtgatcctgaaggggcactctggtga

SEQ ID NO: 5708 - RNA, 9879 nt, synthetic construct
  misc_feature 1..9879: note = derived and/or modified CDS sequence (wt) from DENV-1__FJ182036__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggcaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaatcctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactatggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactgagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatctttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatgtctcagcacaactacaggccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagcagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatcactcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcttactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaacctgaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgttatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaatcactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccaagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5709 - RNA, 9879 nt, synthetic construct
  misc_feature 1..9879: note = derived and/or modified CDS sequence (wt) from DENV-1__FJ205876__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacccagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccacctttatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcctctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggccgaggtctcctgggaagaagaagcagaacactctggcgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacacccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgatccaattgagcaggaaaacctttgatacagagtaccaaaaaacaaaaaacaacgactgggactacgtcgtcacaacagacatctcagaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattattccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctgtcaggaaggggcctagggaaaacatctattggcctactctgcgtaatggcttcaagcgtactgctatggatggccagtgtggagccccattggatagcggcctccatcatactggagttcttcttgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcaacagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaggtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgacaggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgcaggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatctagggaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5710 - RNA, 9879 nt, synthetic construct
  misc_feature 1..9879: note = derived and/or modified CDS sequence (wt) from DENV-1__FJ024455__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagtaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtgacccagaatgggagattgataacagctaaccccatagttactgacaaagaaaaaccagttaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaattggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccccaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggggaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagctatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtagacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaacttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5711 - RNA, 9879 nt, synthetic construct
  misc_feature 1..9879: note = derived and/or modified CDS sequence (wt) from DENV-1__FJ024456__SS-prME
  source 1..9879: mol_type = other RNA
tctgtgaccatgctgcttatgctgatgcccacagccttggcgttccatctgactacacgagggggagagccgcatatgatagttaccaagcaggaaagaggaaagtcacttttgtttaagacctcagcaggcgtcaacatgtgcatccttatagcgatggatttgggagagttatgtgaggacacaatgacttacaaatgccctcggatcactgaggcggaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtattggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacaccgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaatccagaatgggagattgataacagcaaatcctatagtcactgacaaagaaaaaccagtcaacattgaggcagaaccgccttttggtgagagttacatcgtgataggagtaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtgcaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaacacaaccttcatcatcgacggcccaaacaccccagaatgccctgatgatcaaagagcatggaacatttgggaagttgaggactatggatttggaattttcacgacaaatatatggttgaaattgcgtgactcctacactcaagcgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggagagtgaaatggtaattccaaaaatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgtagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgttgatgactggaacattggctgtgttcctccttctcataatggggcaattgacatggaatgatctgatcagattatgcattatggttggagccaacgcttccgacaggatggggatgggaacgacgtacctagctctgatggccacttttaagatgagaccaatgtttgctgtcgggctattattccgtagactaacatccagagaagttctccttcttacaattggattgagtctagtggcatctgtggagttaccaaattccttggaagagctgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagctgacttatcactagagaaagcggctgaggtctcctgggaagaagaagcagaacactctggtgcctcgcacaatatattagtggaggtccaagatgatggaactatgaagataaaggatgaagagagagatgacacgctaaccattcttcttaaagcaactctgctagcagtttcaggggtgtatccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccagaggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaaccaggcacatctggatctcccatcgtgaatagagaaggaaagatagtaggtctttatggaaatggagtggtgacaacaagtggaacctacgtcagtgccatagctcaagccaaagcatcacaagaaggtcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatggaaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgacaatataaacacaccagaagggattatcccagccctcttcgagccagagagggaaaagagtgcagcaatagacggggaatacagactgcggggtgaagcaaggaagacgtttgtggagctcatgagaagaggagatctacctgtttggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgctttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactgcaagcaaaggctactagagaagctcaaaaaaggacagcggccggaataatgaaaaatccaaccgttgatggaattgttgcaatagatttggaccctgtggtctatgatgcaaaatttgagaaacaactaggccaaataatgttgttaatattatgtacttcacagatcctcttgatgaggactacatgggccttgtgcgaatccatcacactggccactggacctctaaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgttgagaggaaccttgtgaaaccagaagggaaagtcatagacctcggctgcggaagaggtggctggtcatactattgcgctgggctgaagaaagtcacagaagtgaagggatatacaaaaggaggacctggcatggaggaaccaatcccaatggcgactaatggatggaacctagtaaaactgcactccgggaaagacgtattctttacaccacctgagaaatgtgacacacttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacttggatatcattggccagaggatagagaacataaaacatgaacacaagtcaacatggcattatgatgaggacaatccatataaaacatgggcctatcacggatcatatgaggtcaaaccatcaggatcagcctcatccatggtcaatggcgtggtgaaactgcttaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaagaaaccaagaatttgtacaagagaggagttcacaaggaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggccacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaacatggcgtcgaaaggctgaaaagaatggcaatcagcggggatgactgcgtggtgaaaccaattgatgacaggttcgcaacagccctaacagctctgaatgatatgggaaaagtgagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtgtccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 5712 - RNA, 9879 nt, synthetic construct
  misc_feature 1..9879: note = derived and/or modified CDS sequence (wt) from DENV-1__FJ024457__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacccagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactgtcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcctctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggccgaggtctcctgggaagaagaagcagaacactctggcgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgatccaattgagcaggaaaacctttgatacagagtaccaaaaaacaaaaaacaacgactgggactacgtcgtcacaacagacatctcagaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtctcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaggtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaattttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtgagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgcaggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5713 - RNA, 9879 nt, synthetic construct
  misc_feature 1..9879: note = derived and/or modified CDS sequence (wt) from DENV-1__FJ205881__SS-prME
  source 1..9879: mol_type = other RNA
tctgtgaccatgctccttctgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtgacccagaatgggagattgataacagctaaccccatagttactgacaaagaaaaaccagttaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaagatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaaacatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaacttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagctatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaacttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5714 - RNA, 9879 nt, synthetic construct
  misc_feature 1..9879: note = derived and/or modified CDS sequence (wt) from DENV-1__FJ205882__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagctttgtgaggacacaatgacttacaagtgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattatcttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtgatagtcaccgtccacactggagaccagcaccaggtgggaaatgaaagcacagaacacgggacaactgcaactataacacctcaagctccttcaacggaaatacagctgaccgactacggagctcttacattggattgttcacctagaacaggactagacttcaatgaaatggtgttgttgacaatgaaagaaaaatcatggctagtccacaaacaatggtttctagacctaccactgccttggacctcgggagcttcaacatcacaagagacttggaacagacaagatttgcttgtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacatgcattgcagttggcctagtaacattatacctaggagtcatggttcaggcggattcaggatgtgtaattaattggaaaggcagagaactcaaatgtggaagtggcatttttgtcaccaatgaagttcacacttggacagagcaatacaaatttcaagctgactccccaaagagactatcagctgccatcgggaaggcatgggatgagggtgtgtgtggaatacgatcagcaactcgtctcgagaacatcatgtggaagcaaatatcaaatgaactgaaccacatcttacttgaaaatgacatgaaattcacagtggtcgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttggaaagttgaggaccatggatttggaattttcccgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctagcaagagcctctttcatagaagtcaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttaatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgttagctgtaggactattattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgtattccttgcactatgcatggaagacaatggccatggtactgtcaattgtatctctcttccccttatgcctgtccacgacctcccaaaaaacaacatggcttccggtgctattgggatctcttggatgcaaaccactaaccatgtttctcatagcagaaaacaaaatctggggaaggaaaagttggcccctcaatgagggaatcatggctgttggaatagtcagcattctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggctccaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcccctaccagagattgaaaacgaagtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcagttgagcagaaaaacttttgatacagagtaccaaaaaacaaaaaataacgactgggactacgtcgtcacaacagacatctctgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgctggaggagaacatggacgtggagatctggacaaaagaaggagaaagaaagaaactaagaccccgctggctggatgctagaacatactcagacccactggccctgcgcgagtttaaagagtttgcagcaggaagaaaaagcgtctcaggtgatctaatattagaaatagggaaacttccacaacacttgacgcaaagggcccagaatgccttggacaatctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcttagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggatgtagacttacatccagcttcagcctggaccctctatgcagtggccacaacaattatcactcccatgatgaggcacacaatcgaaaacacaacggcaaacatttccctgacagccattgcgaaccaggcggctatattaatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacactacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccagctgagcaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattcttcataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaatattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcataggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacaaatcatggaggtgacagccaagtggttatggggttttctctctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcgatctttaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaggtggccataaaccaagtgagaagactaattgggaatgagaattatctagattacatgacatcaatgaagagattcaagaacgagagtgatcctgaaggggcactctggtga

SEQ ID NO: 5715 - RNA, 9879 nt, synthetic construct
  misc_feature 1..9879: note = derived and/or modified CDS sequence (wt) from DENV-1__FJ390388__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggtgagcaccgacgagacaaacgttccgtcgcactggccccacacgtaggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagacttcaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgatgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaacacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggtacactggctgtgttcttccttctcatagtgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcagttgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcaaaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaagaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaagaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggataatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaagtatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5716 - RNA, 9879 nt, synthetic construct
  misc_feature 1..9879: note = derived and/or modified CDS sequence (wt) from DENV-1__FJ024464__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaatcctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactatggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactgagctggttcaagaaaggaagcagcatagggaaaatgtttgaggcaactgccagaggagtacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatctttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatgtctcagcacaactacaggccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagcagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatcactcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcttactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtgcaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaacctgaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaacaagacatgtggcagtggaaccagaggtagccaacctagatatcattggccagaggatagagaacataaaacatgaacataagtcaacatggcattatgacgaggacaatccatataaaacatgggcctatcatggatcatatgaggtcaagccatcaggatcagcctcatccatggtcaatggcgtggtgaaactgctcaccaaaccatgggatgttatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaatcactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccaagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5717 - RNA, 9879 nt, synthetic construct
  misc_feature 1..9879: note = derived and/or modified CDS sequence (wt) from DENV-1__FJ410191__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaaaagtggagacttgggccctgagacacccaggattcacggtgatagccctttttctagcacatgccataggaacatccatcacccagaaagggattattttcatcctgttaatgctggtaacaccatccatggcaatgcgatgtgtgggaataggcagcagggacttcgtggaaggactgtcaggggcaacttgggtagatgtggtactggaacatggaagttgcgtcaccaccatggcaaaagacaaaccaacattggacattgaactcttgaagacggaagtcacaaaccctgccgtcctgcgtaaattgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagtccaacatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgctgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggacgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaacatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaactccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggagtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagttcgtgaggccataaaaaggaagctgcgcacattaattctggctcccacaagggttgtcgcttccgaaatggcagaggcgctcaagggaatgccaataaggtaccaaacaacagcagtgaagggtgaacacacaggaaaagagatagttgacctcatgtgtcacgccactttcaccatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgcactgctatggatggccagtgtggagccccattggatagcggcctccatcatattggagttcttcctgatggtgctgcttattccagagccagacagacaacgcactccgcaggacaaccagctggcatatgtggtgataggtttgttattcatgatactgacagtagcagccaatgagatgggactgctggaaaccacaaagagagatttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttggtactatgcacatcacaaatcctcttgatgcggactacatgggccttgtgtgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatagaagcccagctgataagacagatggagtctgaggaaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgccaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactgattgggaatgagaattatctagattacatgacatcaatgaagagattcaagaacgagagtgatcctgaaggggcactctggtga

SEQ ID NO: 5718 - RNA, 9879 nt, synthetic construct
  misc_feature 1..9879: note = derived and/or modified CDS sequence (wt) from DENV-1__FJ432723__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtaggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagatgtggtactggaacatggaagctgcgtcaccaccatggcgaaagacaaaccaacattggacattgaactcctgaagacggaagtcacaaaccctgccgtcctgcgcaaactgtgcattgaagctaaaatatcaaacaccaccaccgactcaagatgtccaacacaaggagaagccacactcatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatactcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccaacatggaaccgttttagtgcagattaaatacgaaggaacagatgcaccatgcaagatccctttttcgacccaagatgaaaaaggagtaacccagaatgggagattgataacagctaatcctatagtcactgacaaagaaaaaccagtcaacattgaggcagaaccgccttttggtgagagttacatcgtgataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtacaccagatttttggaactgcatacggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaagttcacacttggacagagcaatataaatttcaagctgactccccaaagagattatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaagggaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaacggagttctggaaagtgaaatgataattccaaagatctatggaggaccaatatctcagcacaactacagaccaggatatttcacacaaacggcagggccgtggcatctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagcagaaaaatgttgatgactggaacactggctgtgttcctccttctcataatggggcaattgacatggaatgatctgatcagattatgcatcatggttggagccaacgcttccgacaggatggggatgggaacgacgtacctagctctgatagccacttttaaaatgagaccaatgtttgctgtcgggctactattccgtagactaacatccagagaagttctccttcttacaattggattgagtctagtggcatctgtggagttaccaaattccttggaggagctgggggatggacttgcaatgggcattatgattttaaaattattgactgactttcagtcacatcagctgtgggctaccttgctgtcctttacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcacacaatatattagtggaggtccaagatgatggaactatgaagataaaggacgaagagagagatgacacgctaaccattctccttaaagcaactctgctagcagtttcaggggtgtacccactatcaataccagcgaccctttttgtgtggtacttttggcagaaaaagaaacagagatctggagtgctatgggatacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtgggacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcatcctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcctactctgcgtgatggcttcaagcgtactgctatggatggccagtgtggagccccattggatagcggcctccatcatactggagtttttcctaatggtgctgcttattccagagccagacagacaacgcactccgcaagacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaatcaggcagctatattgatgggacttgacaaaggatggccaatatcgaagatggacataggagttccacttctcgccttagggtgctattcacaggtgaatccactgacgctgacagcggcggtattgatgctagtggctcattacgccataattggacctggactgcaagcaaaggctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctgaccacgctttgggaggggtctccaggaaaattttggaacaccacgatagcggtttccatggcaaacattttcagaggaagttatctagcaggagcaggtctggccttctcattaatgaaatctttaggaggaggtaggagaggcacgggagcccaaggggaaacactgggagagaaatggaaaaggcagctgaaccaactgagcaagtcagaattcaacacttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgatattggtgagtcctctccaaacccaaccatagaagaaggaagaacgttacgtgtcctaaaaatggtggaaccatggctcagagggaaccaattttgcataaaaattctaaatccctatatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacataagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacaccacaccctttggacaacagagggtgttcaaagagaaagttgacacgcgcacaccaaaagcaaaacgaggcacagcacaaatcatggaggtgacagccaaatggttatggggttttctttctagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccggcgaattggagaccccaaatttagccgagagggttctcgactggctggaaaaatatggtgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactgattgggaatgagaattatctagattacatgacatcaatgaagagattcaagaacgagggcgatcccgaaggggcactctggtga

SEQ ID NO: 5719 - RNA, 9879 nt, synthetic construct
  misc_feature 1..9879: note = derived and/or modified CDS sequence (wt) from DENV-1__FJ410192__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggttagtccacaaacaatggtttttagacctaccactgccttggacctcgggagcttcaacatcacaagagacttggaacagacaagatctgctggtgacatttaagacagctcatgcaaagaagcaggaagtagtcgtgctaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggcttatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggtacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagcctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatgatactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcttggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtgggtctttatggaaatggagtagtgacaacaagtggaacctacgtcagtgccatagctcaagccaaagcatcacaagaagggcccctaccagagattgaagacgaggtgttcaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctaatgtgtcacgccactttcaccatgcgcctcctgtctcccgtaagagttcccaattacaacatgatcatcatggatgaagcacatttcactgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacactacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaaccatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtagaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgttcaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacttaccaaaataaggtggtaagggtacagagcccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5720 - RNA, 9879 nt, synthetic construct
  misc_feature 1..9879: note = derived and/or modified CDS sequence (wt) from DENV-1__FJ410194__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgcaaagttcaagtgtgtgacaaaactggaaggaaagatagttcaatatgagaacttgaaatattcagtaatagtcaccgttcacaccggagaccagcatcaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggttcaggcggattcaggatgtgtaattaattggaaaggtagagaactcaagtgtggaagtggcatttttgtcaccaatgaagttcacacttggacagagcaatacaaatttcaagctgactcccctaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctcattcatagaagttaaaacatgtatctggccaaaatcccacactctatggagcaatggagttctggaaagtgaaatgataattccaaagatctatggaggaccaatatctcagcacaactacagaccaggatattttacacaagcagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaagaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgttcgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaatcctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgctcagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctctttgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccctggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctatcggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggttcgtggagaggaaccttgtgaaaccagaagggaaagtcatagacctcggttgtggaagaggtggctggtcatactattgcgctgggctgaagaaagtcacagaagtgaaggggtatacaaaaggaggacctggacatgaggaaccaatcccaatggcgacctatggatggaacctagtaaagctgccctctgggaaagacgtattttttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgagcccagaattactgacatcatggaacccgaacatgccctcctggctaagtcaatcttcaagttaacctaccaaaataaggtggtaagggtacagagcccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttggtcacaccacttccaccagctgattatgaaggatgggagggaaatagtggtgccatgccgcaaccaagatgaacttgtgggtagggctagagtatcacaaggtgctggatggagcctgagagaaactgcatgcctagccaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5721 - RNA, 9879 nt, synthetic construct
  misc_feature 1..9879: note = derived and/or modified CDS sequence (wt) from DENV-1__FJ432725__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgcaaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggttcaggcggattcaggatgtgtaattaattggaaaggtagagaactcaagtgtggaagtggcatttttgtcaccaatgaagttcacacttggacagagcaatacaaatttcaagctgactcccctaagagactatcagcagccattgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctcattcatagaagttaaaacatgtatctggccaaaatcccacactctatggagcaatggagttctggaaagtgaaatgataattccaaagatctatggaggaccaatatctcagcacaactacagaccaggatattttacacaagcagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaagaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgttcgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaatcctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgctcagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctggggtaactgggggagtgacacttgttttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgccaaaggatggccaatatcgaagatggacataggagttccacttctcgccttggggtgctattcccaggtgaatccactgacgctgacagcgccggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggttcgtggagaggaaccttgtgaaaccagaagggaaagtcatagacctcggttgtggaagaggtggctggtcatactattgcgctgggctgaagaaagtcacagaagtgaaggggtatacaaaaggaggacctggacatgaggaaccaatcccaatggcgacctatggatggaacctagtaaagctgcactccgggaaagacgtattttttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaccaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggccaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgggcatagagagagggagcttcacaaacagggaaaatgtgctacgtgtgtttccaacatgatggggaagagagagaaaaagctaggagagttcggaaagccaaaaggaagtcgtccaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagccgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5722 - RNA, 9879 nt, synthetic construct
  misc_feature 1..9879: note = derived and/or modified CDS sequence (wt) from DENV-1__FJ432729__SS-prME
  source 1..9879: mol_type = other RNA
tctgtgactatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgtcataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgttctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgactaaactggaaggaaagatagttcaatatgaaaacttgaaatattcagtaatagtcaccgtccacactggagaccagcaccaggtgggaaatgaaagcacagaacatgggacaattgcaactataacaccccaagctcccacgtcggaaatacagctgaccgactacggagctctcacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagacttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagattgataacagctaatcctatagtcactgacaaagaaaaaccagtcaacattgaggcagaaccgccttttggtgagagttacatcgtgataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtacaccagatctttggaaccgcatatggagttttgttcagcggtgtttcctggaccatgaaaataggaataggggttctgctgacatggctgggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaggttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaatttacagtggttgtaggagatgtagttgggatcttggctcaagggaaaaaaatgatcaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcccacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaacggagttctggaaagtgaaatgataattccaaagatctatggaggaccaatatctcagcacaattacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcgatggtctctgcagggtcaggggaagtggacagcttttcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactagccatgcttcttatagcagaaaacaaaatctggggaaggaaaagttggcccctcaatgaaggaattatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcacacaatatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtacttatgtaccaagggaagagactagaaccgagttgggccagtgtcaaaaaagacctgatctcatatggaggaggttggaggcttcaaggatcttggaacacgggagaagaagtgcaggtgattgctgttgaaccaggaaaaaaccccaaaaatgtacaaacagcgccaggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggaatgggtgaagcagctgcgatcttcatgacagccactcccccaggatcggtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcagaaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgcgtcattctagcaggaccgatgccagtaactgtagccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggatcatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagtgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgctgactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacagctaggccaaataatgttgttaatactatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggggaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccttacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttactaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtagtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttctagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagatatatcaaagattccagggggaaatatgtatgcagatgacacagccggatgggatacaaggataacagaggatgatcttcagaatgaggccagaattactgacatcatggagcccgaacatgccctactggctacgtcaatctttaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgaaggaatctttttacccagcgaattggagacccaaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcttccaacatacaagtggccataaaccaagtgagaagactaattgggaatgagaattatctagattacatgacatcaatgaagagattcaagaacgagggtgatcccgaaggggcactctggtga

SEQ ID NO: 5723 - RNA, 9879 nt, synthetic construct
  misc_feature 1..9879: note = derived and/or modified CDS sequence (wt) from DENV-1__FJ432730__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaatgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgtttagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcgactcgtctcgagaacatcatgtggaagcaaatatcaaatgaactgaaccacatcttacttgaaaatgacatgaaattcacagtggttgtaggagatgttgctggaatcttggctcaaggaaaaaaaatgattaggccacaacccatggaatacaaatactcgtggaaaagctggggaaaggccaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattgttccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttctccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtagaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttgacaataatggacctacatccaggatcggggaaaacaagaagatatcttccagccatagtccgtgaggccataaaaaggaagctgcgcacattaattctggctcccacaagagttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattattatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtatatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacgtactcagacccactggccctgcgcgagtttaaagagtttgcagcaggaagaagaagcgtctcaggtgatctaatattagaaatagggaaacttccacaacacctgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttagggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctctgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgacctccagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccaggagagttcttgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagttgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggtgcactctggtga

SEQ ID NO: 5724 - RNA, 9879 nt, synthetic construct
  misc_feature 1..9879: note = derived and/or modified CDS sequence (wt) from DENV-1__FJ432732__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaaatcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgtcataggaacatccatcacccagaaagggattattttcattttgctaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaagtgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagttactgacaaagaaaaaccagtcaacattgaggcagaaccgccctttggtgagagttacatcacaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcttggaccatgaaaataggaataggggttctgctgacatggctgggattaaactcaaggagcacgtccctttcgatgacgtgcattgcagttggcctagtaacactatacctaggagtcatggttcaggcggattcaggatgtgtaatcaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacattttacttgaaaatgatatgaaattcacagtggttgtaggagatgttgctgggatctttgctcaaggaaagaaaatgattaggccacaacccatggaatacaaatactcatggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgctatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcctcttaatgaaggaatcatggctgttggaatagtcagcatcctactaagttcactcctaaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatccggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgttggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctctgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccctgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgttacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctaattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagaggttcaagaacgagagtgatcccgaaggggcactctggtga

SEQ ID NO: 5725 - RNA, 9879 nt, synthetic construct
  misc_feature 1..9879: note = derived and/or modified CDS sequence (wt) from DENV-1__FJ432733__SS-prME
  source 1..9879: mol_type = other RNA
tctgtgactatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggtggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgtcataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgttctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgactaaactggaaggaaagatagttcaatatgaaaacttgaaatattcagtaatagtcaccgtccacactggagaccagcaccaggtgggaaatgaaagcacagaacatgggacaattgcaactataacaccccaagctcccacgtcggaaatacagctgaccgactacggagctctcacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagacttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagattgataacagctaatcctatagtcactgacaaagaaaaaccagtcaacattgaggcagaaccgccttttggtgagagttacatcgtgataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtacaccagatctttggaaccgcatatggagttttgttcagcggtgtttcctggaccatgaaaataggaataggggttctgctgacatggctgggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaggttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaatttacagtggttgtaggagatgtagttgggatcttggctcaagggaaaaaaatgatcaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcccacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaacggagttctggaaagtgaaatgataattccaaagatctatggaggaccaatatctcagcacaattacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcgatggtctctgcagggtcaggggaagtggacagcttttcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactagccatgcttcttatagcagaaaacaaaatctggggaaggaaaagttggcccctcaatgaaggaattatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcacacaacatattagtggaggtccaagatgatggaactatgaagataaaggatgaagagagagatgatacgctaaccattctccttaaagcaactctgctagcagtttcaggggtgtacccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtacttatgtaccaagggaagagactagaaccgagttgggccagtgtcaaaaaagacctgatctcatatggaggaggttggaggcttcaaggatcttggaacacgggagaagaagtgcaggtgattgctgttgaaccaggaaaaaaccccaaaaatgtacaaacagcgccaggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggaatgggtgaagcagctgcgatcttcatgacagccactcccccaggatcggtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcagaaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgcgtcattctagcaggaccgatgccagtaactgtagccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggatcatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagtgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgctgactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacagctaggccaaataatgttgttaatactatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggggaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccttacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttactaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtagtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttctagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagatatatcaaagattccagggggaaatatgtatgcagatgacacagccggatgggatacaaggataacagaggatgatcttcagaatgaggccagaattactgacatcatggagcccgaacatgccctactggctacgtcaatctttaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgaaggaatctttttacccagcgaattggagacccaaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcttccaacatacaagtggccataaaccaagtgagaagactaattgggaatgagaattatctagattacatgacatcaatgaagagattcaagaacgagggtgatcccgaaggggcactctggtga

SEQ ID NO: 5726 - RNA, 9879 nt, synthetic construct
  misc_feature 1..9879: note = derived and/or modified CDS sequence (wt) from DENV-1__FJ410196__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgcaaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggttcaggcggattcaggatgtgtaattaattggaaaggtagagaactcaagtgtggaagtggcatttttgtcaccaatgaagttcacacttggacagagcaatacaaatttcaagctgactcccctaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggttgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctcattcatagaagttaaaacatgtatctggccaaaatcccacactctatggagcaatggagttctggaaagtgaaatgataattccaaagatctatggaggaccaatatctcagcacaactacagaccaggatattttacacaagcagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaagaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgttcgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctgggagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaatcctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccattcagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgttacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgctcagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaagtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggttcgtggagaggaaccttgtgaaaccagaagggaaagtcatagacctcggttgtggaagaggtggctggtcatactattgcgctgggctgaagaaagtcacagaagtgaaggggtatacaaaaggaggacctggacatgaggaaccaatcccaatggcgacctatggatggaacctagtaaagctgcactctgggaaagacgtattttttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagaggcatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5727 - RNA, 9879 nt, synthetic construct
  misc_feature 1..9879: note = derived and/or modified CDS sequence (wt) from DENV-1__FJ432734__SS-prME
  source 1..9879: mol_type = other RNA
tctgtgaccatgctccttatgctgatgcctacagccttggcgttccatttgaccacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggtcctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgccgacgaacgtttgtggacagaggctggggcaatggctgtgggcttttcggaaaaggaagcctaataacgtgtgctaagtttaagtgtgtgacaaaactggaaggaaagatagtccaatatgaaaacttgaaatactcagtaatagtcactgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgtactaggatcgcaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaggtggctgagacccagcatggaaccgttctagtgcagattaaatacgaaggaacagatgcaccatgcaagatccccttttcgacccaagatgagaaaggagtaacccagaatgggagattgataacagccaaccccatagtcactgacaaagaaaaaccagtcaacattgaggcagaaccgccttttggtgagagttacatcgtgataggagcaggtgaaaaagctttgaagctaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagtcggcctagtaacgctatacttaggagtcatggttcaggcagattcaggatgtgtaattaactggaaaggtagagaactcaaatgtggaagtggcatttttgtcaccaatgaagttcatacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaactcacagtggttgtaggagatgttgctgggatcttgggccaagggaagaaaatgattaggccacaacccatggaatataaatactcgtggaaaagctggggaaaggctaaaatcataggggcagatgcacagaacaccaccttcatcatcgacggcccaaacaccccggaatgccctgatgatcaaagagcatggaacatttgggaagttgaggattatggatttggaatgttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatcccacactctatggagcaatggagttttggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcctccgacaggatggggatgggaacgacgtatctagctctgatggccacttttaaaatgagaccaatgtttgctgtggggctgctattccgcagactaacatccagagaagttcttcttctaacaattggattgagtctagtggcatctgtggagttaccaaattccttggaggagctgggggatggacttgcaatgggcattatgattttaaaattgttgactgactttcaatcacatcagctgtgggctaccttgctgtccttgacatttatcaaaacaacattttctttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatttggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatactagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtgctcatgtatcaagggaagagactggaaccgagctgggccagtgtcaaaaaagacctgatctcatatggaggaggttggaggcttcgaggatcctggaacacgggagaagaagtgcaggtgattgctgttgaaccagggaaaaaccccaaaaatgtacaaacggcgccgggcacctttaagacccctgaaggcgaagttggagccattgctctagattttaaacccggcacatctggatctcccatcgtgaacagagaaggaaaaatagtgggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacattttacagatccatccagcatagcggccagagggtacatctcaacccgagtgggcatgggtgaagcggctgcgatcttcatgacagccactcccccaggatcagtggaggcctttccacagagcaacgcagttatccaagatgaggaaagagacattcctgagagatcatggaactcaggctatgagtggatcaccgacttcccaggcaaaacagtttggtttgttccaagcattaaatcaggaaatgacattgccaactgcttaagaaagaatgggaagcgggtgattcaattgagcaggaaaacctttgacacagagtaccaaaaaacaaaaaataacgactgggactacgttgtcacaacagacatctccgaaatgggagcgaatttccgggccgatagggtgatagacccaagacggtgtctgaaaccggtaatactaaaggatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcagtagacggggaatacagactgcgaggtgaagcaaggaaaacgtttgtggagctcatgagaagaggagatctacctgtctggctatcctacaaagttgcttcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaataggaaaacttccacaacacttgacgcaaagggcccagaatgccttggacaacctggttatgctgcacaattccgaacaaggaggaagagcctatagacatgcaatggaagaactgccagacaccatagaaacgttaatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacagcaaacatttccctgacagccattgcaaaccaggcagctatattgatgggacttgacaaaggatggccaatatcgaagatggacataggggttccacttctcgctttggggtgctattcccaggtgaatccactgacgctgacagcggcggtattgatgctagtggcccattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatttagcaggagcaggtctggccttctcattaatgaaatctctaggaggaggtaggagaggcacaggagcccaaggggaaacactgggagagaaatggaaaagacagctgaaccaactgagcaagtcagaattcaacacctataaaaggagtgggattatggaagtggacagatctgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaggtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcctctccaaacccaactatagaggaaggaagaacgctacgcgtcctaaagatggtggaaccatggctcagaggaaaccaattctgcataaaaattctgaatccctacatgccaagtgtggtggaaactctggagcaaatgcaaagaaaacatggaggaatgctagtgcgaaatccactttcaagaaattctacccatgaaatgtattgggtttcatgtggaacaggaaacattgtgtcagctgtaaacatgacatctagaatgttgctaaatcgattcacaatggctcacaggaaaccaacatatgaaagagacgtggacctaggcaccggaacaagacatgtggcagtggaaccagaggtagccaacctagatattattggccagaggatagagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttgggcaacagagggtgtttaaagagaaagttgacacacgcacaccaaaagcaaaacgaggtacagcacaaatcatggaggtgacagccaggtggttatggggttttctttctagaaacaagaaaccaagaatttgtacaagagaggagttcacaagaaaagttaggtcaaacgcagccatcggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagtttggaaaggcaaaaggaagtcgtgcaatatggtacatgtggttgggagcacgttttctagagttcgaagctcttggtttcatgaacgaagaccactggttcagtagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgttatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagctctcgattggctggaaaaatatggcgtcgaaaggctaaaaagaatggcaatcagtggagatgattgcgtagtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacaggagagacctaagactggccgctaatgctatctgttcagccgttccagttgattgggtcccaactagccgcaccacctggtcgatccatgcccatcaccaatggatgacaacagaagacatgctgtcagtgtggaatagggtttggatagaggaaaacccatggatggaggacaaaacccatatatccagctgggaagatgttccatatttagggaaaagggaagatcaatggtgtggatccctgataggcttaacagcaagggccacctgggccaccaacatacaagtggctataaaccaagtgagaagactaattgggaatgagaattatctagattacatgacatcaatgaagagattcaagaacgagactgatcccgaaggggcactctggtga

SEQ ID NO: 5728 - RNA, 9879 nt, synthetic construct
  misc_feature 1..9879: note = derived and/or modified CDS sequence (wt) from DENV-1__FJ432735__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgtattgaagctaaaatatcaaacaccaccactgattcaagatgtccaacacaaggagaagccacactggtggaagaacaagacgcgaactttgtgtgtcgacgaacgtttgtggatagaggctggggcaatggatgtgggctcttcggaaaaggaagcctaataacgtgtgctaagttcaagtgtgtaacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcaacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatctttgcaggacacttgaaatgtagactaaagatggacaagctgactctaaaagggatgtcatatgttatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatctgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttgtgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtatcaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacgacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggagatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggcgatctaatattagaaatagggaaacttccacaacacttgacgcaaaaggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccactggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaataagaaaccgagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggcagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 5729 - RNA, 9879 nt, synthetic construct
  misc_feature 1..9879: note = derived and/or modified CDS sequence (wt) from DENV-1__FJ432736__SS-prME
  source 1..9879: mol_type = other RNA
tctgtgaccatgctccttatgctgatgcccacagccttggcgttccatttgaccacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattattttcattttgttaatgctggttacaccatccatggccatgcgatgcgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagtttaagtgtgtgacaaaactggaaggaaagatagtccaatatgaaaacttgaaatactcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaggtggctgagacccagcatggaaccgttctagtgcagattaaatacgaaggaacagatgcaccatgcaagatccccttttcgacccaagatgagaaaggagtaacccagaatgggagattgataacagccaaccccatagtcactgacaaagaaaaaccagtcaacattgaggcagaaccgccttttggtgagagttacatcgtgataggagcaggtgaaaaagctttgaagctaagctggttcaagaaaggaagcagcatagggaaaatgtttgaggcaactgccagaggagcacgaaggatggccatactgggagacaccgcatgggactttggttctataggaggagtgttcacgtctgttggaaaattaatacaccagatttttggaactgcatatggagttttgttcagcggtgtttcctggaccatgaaaataggaataggggttctgctgacatggctaggattaaactcaaggagcacgtccctttcgatgacgtgcattgcagtcggcctagtaacgctatacttaggagtcatggttcaggcggattcgggatgtgtaattaactggaaaggtagagaactcaaatgtggaagtggcatttttgttaccaatgaagttcatacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaactcacagtggttgtaggagatgttgctgggatcttgggccaaggaaaaaaaatgattaggccacaacccatggaatataaatactcgtggaaaagctggggaaaggctaaaatcataggggcagatgcacagaacaccaccttcatcatcgacggcccaaacaccccggaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcatgctgacatggggtactggatagaaagtgagaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatatctcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagttaaggaaaaggaagagaatctagtcaaatcaatggtctctgcagggccaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgccttcgacaggatggggatgggaacgacgtatctagctctgatggccacttttaaaatgagaccaatgtttgctgtggggctgctattccgcagactaacatccagagaagttcttcttctaacaattggattgagtctagtggcatctgtggagttaccaaattccttggaggagctgggggatggacttgcaatgggcattatgattttaaaattgttgactgactttcaatcacatcagctgtgggctaccttgctgtccttgacatttatcaaaacaacattttctttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatttggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaatatactagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcgaggatcctggaacacgggagaagaagtgcaggtgattgctgttgaaccagggaaaaaccccaaaaatgtacaaacggcgccgggcacctttaagacccctgaaggcgaagttggagccattgctctagattttaaacccggcacatctggatctcccatcgtgaacagagaaggaaaaatagtaggtctttatggaaatggagtagtgacaacaagtggaatctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgtctcctgtctcccgtgagagttcccaattacaacatgattatcatggatgaagcacattttacagatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggccatgagtggatcaccgacttcccaggcaaaacagtttggtttgttccaagcattaaatcaggaaatgacattgccaactgcttaagaaagaatgggaagcgggtgattcaattgagcaggaaaacctttgacacagagtaccaaaaaacaaaaaataacgactgggactacgtcgtcacaacagacatctccgaaatgggagcgaatttccgggccgacagggtgatagacccaagacggtgtctgaaaccggtaatactaaaggatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcagtagacggggaatacagactgcgaggtgaagcaaggaaaacgtttgtggagctcatgagaagaggagatctacctgtctggctatcctacaaagttgcttcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaataggaaaacttccacaacacttgacgcaaagggcccagaatgccttggacaacctggttatgctgcacaattccgaacaaggaggaagagcctatagacatgcaatggaagaactgccagacaccatagaaacgttaatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagtttttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacagcaaacatttccctgacagccattgcaaatcaggcagctatattgatgggacttgacaaaggatggccaatatcgaagatggacataggggttccacttctcgctttggggtgctactcccaggtgaatccactgacgctgacagcggcggtattgatgctagtggcccattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatttagcaggagcaggtctggccttctcattaatgaaatccctaggaggaggtaggagaggcacaggagcccaaggggaaacactgggagagaaatggaaaagacagctgaaccaactgagcaagtcagaattcaacacctataaaaggagtgggattatggaagtggacagatctgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaggtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcctctccaaacccaactatagaggaaggaagaacgctacgcgtcctaaagatggtggagccatggctcagaggaaaccaattctgcataaaaattctgaatccctacatgccaagtgtggtggaaactctggagcaaatgcaaagaaaacatggaggaatgctagtgcgaaatccactttcaagaaattctacccatgaaatgtattgggtttcatgtggaacaggaaacattgtgtcagcagtaaacatgacatccagaatgttgctaaatcgattcacaatggctcacaggaaaccaacatatgaaagagacgtggacctaggcaccggaacaagacatgtggcagtggaaccagaggtagccaacctagatattattggccagaggatagagaacataaaacatgaacacaagtcaacatggcattatgatgaggacaatccatacaaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttgggcaacagagggtgtttaaagagaaagttgacacacgcacaccaaaagcaaaacgaggtacagcacaaatcatggaggtgacagccaggtggttatggggttttctttctagaaacaagaaaccaagaatttgtacaagagaggagttcacaagaaaagttaggtcaaacgcagccatcggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagtttggaaaggcaaaaggaagtcgtgcaatatggtacatgtggttgggagcacgttttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacacgccctactggctaaggcaatcttcaagctaacctaccaaaataaagtggtaagggtacagagaccagcaaaaaatggaaccgtgatggatgttatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagctctcgattggctggaaaaatatggcgtcgaaaggctaaaaagaatggcaatcagtggagatgattgcgtagtgaaaccaattgatgataggtttgcaacagccttaacagctctgaatgatatgggaaaagtaagaaaagatataccacaatgggaaccttcaaaaggatggaatgattggcagcaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacagaagagacctaagactagccgctaatgctatctgttcagccgttccagttgattgggtcccaactagccgcaccacctggtcgatccatgcccatcaccaatggatgacaacagaagacatgctgtcagtgtggaatagggtttggatagaggaaaacccatggatggaggacaaaacccatatatccagctgggaagatgttccatatttagggaaaagggaagatcaatggtgtggatccctgataggcttaacagcaagggccacctgggccaccaacatacaagtggctataaaccaagtgagaagactaattgggaatgagaattatctagattacatgacatcaatgaagagattcaagaacgagagtgatcccgaaggggcactctggtga

SEQ ID NO: 5730 - RNA, 9879 nt, synthetic construct
  misc_feature 1..9879: note = derived and/or modified CDS sequence (wt) from DENV-1__FJ410198__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcttaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagtccacacttggacagagcaatacaaatttcaagctgactccccaaagagactatcagcagccatcgggaaggcatgggaggagggtgtgtgtggaattagatcagcaactcgtctcgagaacatcatgtggaagcaaatatcaaatgaactgaatcacatcttacttgaaaatgatatgaaattcacagtggttgtaggtgatgttgctgggatcttggctcaaggaaagaaaatgatcaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggatagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatttatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgaccctcttcgtgtggtacttttggcagaaaaagaaacagagatctggagtgttatgggacacacccagccctccagaagtgggaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctagttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccacaatgctggatgtagacttacatccagcttcagcctggaccctctatgcagtggccacaacaattattactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggctggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataagaggagtggaattatggaagtggacagatccgaagccaaagagggattaaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaagccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaacattccagggggaaacatgtatgcagatgacacagccggatgggatacaaggataacagaggatgaccttcagaatgaggccagaattactgacatcatggaacctgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaatactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagctggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5731 - RNA, 9879 nt, synthetic construct
  misc_feature 1..9879: note = derived and/or modified CDS sequence (wt) from DENV-1__FJ410199__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaacagaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggggtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgatcaccggctaatgtcagctgccatcaaggacagcaaggcagttcacgctgacatggggtactggatagaaagtgaaaagaacgagacctggaagctggcaagagcctccttcatagaagttaaaacatgtatctggccaaagtcccacactctatggagcaatggagttctggaaagtgaaatgataattccaaagaactatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgctcttccttctcataatgggacaattgacatggagtgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacaacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacctaacaataatggacctacatccaggatcggggaaaacaagaaaatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgaccttatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcctccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaagcttccacaacacttgacgcaaagggcccagaacgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgttgacagcggcggtgttgatgctagtggctcattacgccataattggacctggactgcaagcaaaagctactagagaagctcaaaaaaggacagcggccggaataatgaagaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttacctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatctatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagtttacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgacctccagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaagagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagttagaagactaattgggaatgagaattatctagattacatgacatcaatgaagagattcaagaacgagagtgatcctgaaggggcactctggtga

SEQ ID NO: 5732 - RNA, 9879 nt, synthetic construct
  misc_feature 1..9879: note = derived and/or modified CDS sequence (wt) from DENV-1__FJ432739__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttaggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacgagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaagcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatacctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacatcagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcatggaaaagctggggaaaggctaaaatcataggggcagatgtgcagaatgccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaatactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcattatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattggtggaggtccaagatgatggaaccatgaagataaaggatgaagagagagatgacacgctaaccattctcctgaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgccttctgtctcccgtgagagttcccaattacaacatgattatcatggatgaagcacatttcaccgatccatccagcatagcggccagagggtacatctcaacccgagtgggtatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaataacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcttatagacatgcaatggaggaactgccagacaccatagaaacgttgatgctcctagctttgatagctgtgttaactggtggagtgacgctgttcttcctatcagggaggggcctagggaaaacatctatcggcctactctgtgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttatttatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgttattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatacaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtctccatggcaaacatttttagaggaagttatctagcaggagcaggtctggccttctcattaatgaaatctctaggaggaggtaggagaggtacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgagttagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagattgatcctgaaggggcactctggtga

SEQ ID NO: 5733 - RNA, 9879 nt, synthetic construct
  misc_feature 1..9879: note = derived and/or modified CDS sequence (wt) from DENV-1__FJ410201__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgttcaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagtttaagtgtgtgacaaaactggaaggaaaaatagtccaatatgaaaacttgaaatactcagtaatagtcaccgtccacactggagaccagcaccaggtgggaaatgaaagcacagaacatgggacaactgcaactataacacctcaagctcctacgacggaaatacagctgactgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccccttttcgacccaagatgagaaaggagtaacccagaatgggagattgataacagccaaccccatagtcactgacaaagaaaaaccagtcaacattgaggcagaaccgccttttggtgagagttacatcgtgataggagcaggtgaaaaagctttgaagctaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagtcggcctagtaacgctatacttaggagtcatggttcaggcggattcaggatgtgtaattaactggaaaggtagagaactcaaatgtggaagtggcatttttgttaccaatgaagttcatacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttactcgaaaatgacatgaaactcacagtggttgtaggagatgttgctgggatcttgggccaaggaaaaaaaatgattaggccacaacccatggaatataaatactcgtggaaaagctggggaaaggctaaaatcataggggcagatgcacagaacaccaccttcatcatcgacggcccaaacaccccggaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcctccgacaggatggggatgggaacgacgtatctagctctgatggccacttttaaaatgagaccaatgtttgctgtggggctgctattccgcagactaacatccagagaagttcttcttctaacaattggattgagtctagtggcatctgtggagttaccaaattccttggaggagctgggggatggacttgcaatgggcattatgattttaaaattgttgactgactttcaatcacatcagctgtgggctaccttgctgtccttgacatttatcaaaacaacattttctttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatttggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcgaggatcctggaacacgggagaagaagtgcaggtgattgctgttgaaccaggaaaaaaccccaaaaatgtacaaacggcgccgggcacctttaagacccctgaaggcgaagttggagccattgctctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacattttacagatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcaccgacttcccaggcaaaacagtttggtttgttccaagcattaaatcaggaaatgacattgccaactgcctaagaaagaatgggaagcgggtgattcaattgagcaggaaaacctttgacacagagtaccaaaaaacaaaaaataacgactgggactacgtcgtcacaacagacatctccgaaatgggagcgaatttccgggccgacagggtgatagacccaagacggtgtctgaaaccggtaatactaaaggatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcagtagacggggaatacagactgcgaggtgaagcaaggaaaacgtttgtggagctcatgagaagaggagatctacctgtctggctatcctacaaagttgcttcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggttatgctgcacaattccgaacaaggaggaagagcctatagacatgcaatggaagaactgccagacaccatagaaacgttaatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacagcaaacatttccctgacagccattgcaaaccaggcagctatattgatgggacttgacaaaggatggccaatatcgaagatggacataggggttccacttctcgctttggggtgctattcccaggtgaatccactgacgctgacagcggcggtattgatgctagtggcccattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatttagcaggagcaggtctggccttctcattaatgaaatctctaggaggaggtaggagaggcacgggagcccaaggggaaacactgggagaaaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaggtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcctctccaaacccaactatagaggaaggaagaacgctacgcgtcctaaagatggtggagccatggctcagaggaaaccaattctgcataaaaattctgaatccctacatgccaagtgtggtggaaactctggagcaaatgcaaagaaaacatggaggaatgctagtgcgaaatccactttcaagaaattctacccatgaaatgtattgggtttcatgtggaacaggaaacattgtgtcagcagtaaacatgacatccagaatgttgctaaatcgattcacaatggctcacaggaaaccaacatatgaaagagacgtggacctaggcaccggaacaagacatgtggcagtggaaccagaggtagccaacctagatattattggccagaggatagagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttgggcaacagagggtgtttaaagagaaagttgacacacgtacaccaaaagcaaaacgaggcacagcacaaatcatggaggtgacagccaggtggttatggggttttctttctagaaacaagaaaccaagaatttgtacaagagaggagttcacaagaaaagttaggtcaaacgcagccatcggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagtttggaaaggcaaaaggaagtcgtgcaatatggtacatgtggttgggagcacgttttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgttatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagctctcgattggctggaaaaatatggcgtcgaaaggctaaaaagaatggcaatcagtggagatgattgcgtagtgaaaccaattgatgataggtttgcaacagccttaacagctctgaatgatatgggaaaagtaagaaaagacataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacaggagagacctaagactagccgctaatgctatctgttcagccgttccagttgattgggtcccaactagccgcaccacctggtcgatccatgctcatcaccaatggatgacaacagaagacatgctgtcagtgtggaatagggtttggatagaggaaaacccatggatggaggacaaaacccatatatccagctgggaagatgttccatatttagggaaaagggaagaccaatggtgtggatccctgataggcttaacagcaagggccacctgggccaccaacatacaagtggctataaaccaagtgagaagactaattgggaatgagaattatctaaattacatgacatcaatgaagagattcaagaacgagagtgatcctgaaggggcactctggtga

SEQ ID NO: 5734 - RNA, 9879 nt, synthetic construct
  misc_feature 1..9879: note = derived and/or modified CDS sequence (wt) from DENV-1__FJ410203__SS-prME
  source 1..9879: mol_type = other RNA
tctgtgaccatgctccttatgctgatgcctacagccttggcgttccatttgaccacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgctcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattattttcattttgttaatgctggttacaccatccatggccatgcgatgcgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagtttaagtgtgtgacaaaactggaaggaaagatagtccaatatgaaaacttgaaatactcagtaatagtcaccgtccacactggagaccagcaccaggtgggaaatgaaagcacagaacatgggacaactgcaactataacacctcaagctcctacgacggaaatacagctaaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaggtggctgagacccagcatggaaccgttctagtgcagattaaatacgaaggaacagatgcaccatgcaagatccccttttcgacccaagatgagaaaggagtaacccagaatgggagattgataacagccaaccccatagtcactgacaaagaaaaaccagtcaacattgaggcagaaccgccttttggtgagagttacatcgtgataggagcaggtgaaaaagctttgaagctaagctggttcaagaaaggaagcagcatagggaaaatgtttgaggcaactgccagaggagcacgaaggatggccatactgggagacaccgcatgggactttggttctataggaggagtgttcacgtctgttggaaaattaatacaccagatttttggaactgcatatggagttttgttcagcggtgtttcctggaccatgaaaataggaataggggttctgctgacatggctaggattaaactcaaggagcacgtccctttcgatgacgtgcattgcagtcggcctagtaacgctatacttaggagtcatggttcaggcggattcaggatgtgtaattaactggaaaggtagagaactcaaatgtggaagtggcatttttgttaccaatgaagttcatacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaactcacagtggttgtaggagatgttgctgggatcttgggccaagggaaaaaaatgattaggccacaacccatggaatataaatactcgtggaaaagctggggaaaggctaaaatcataggggcagatgcacagaacaccaccttcatcatcgacggcccaaacaccccggaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgagaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgccttcgacaggatggggatgggaacgacgtatctagctctgatggccacttttaaaatgagaccaatgtttgctgtggggctgctattccgcagactaacatccagagaagttcttcttctaacaattggattgagtctagtggcatctgtggagttaccaaattccttggaggagctgggggatggacttgcaatgggcattatgattttaaaattgttgactgactttcaatcacatcagctgtgggctaccttgctgtccttgacatttatcaaaacaacattttctttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatttggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaatatactagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcgaggatcctggaacacgggagaagaagtgcaggtgattgctgttgaaccagggaaaaaccccaaaaatgtacaaacggcgccgggcacctttaagacccctgaaggcgaagttggagccattgctctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgtctcctgtctcccgtgagagttcccaattacaacatgattatcatggatgaagcacattttacagatccatccagcatagcggccagagggtacatctcaacccgagtgggcatgggtgaagcagctgcgatcttcatgacagccactcccccaggatcagtggaggcctttccacagagcaacgcagtcatccaagatgaggaaagagacattcctgagagatcatggaactcaggccatgagtggatcaccgacttcccaggcaaaacagtttggtttgttccaagcattaaatcaggaaatgacattgccaactgcttaagaaagaatgggaagcgggtgattcaattgagcaggaaaacctttgacacagagtaccaaaaaacaaaaaataacgactgggactacgtcgtcacaacagacatctccgaaatgggagcgaatttccgggccgacagggtgatagacccaagacggtgtctgaaaccggtaatactaaaggatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcagtagacggggaatacagactgcgaggtgaagcaaggaaaacgtttgtggagctcatgagaagaggagatctacctgtctggctatcctacaaagttgcttcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaataggaaaacttccacaacacttgacgcaaagggcccagaatgccttggacaacctggttatgctgcacaattccgaacaaggaggaagagcctatagacatgcaatggaagaactgccagacaccatagaaacgttaatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagtttttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacagcaaacatttccctgacagccattgcaaaccaggcagctatattgatgggacttgacaaaggatggccaatatcgaagatggacataggggttccacttctcgctttggggtgctactcccaggtgaatccactgacgctgacagcggcggtattgatgctagtggcccattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatttagcaggagcaggtctggccttctcattaatgaaatccctaggaggaggtaggagaggcacaggagcccaaggggaaacactgggagagaaatggaaaagacagctgaaccaactgagcaagtcagaattcaacacctataaaaggagtgggattatggaagtggacagatctgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaggtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcttctccaaacccaactatagaggaaggaagaacgctacgcgtcctaaagatggtggagccatggctcagaggaaaccaattctgcataaaaattctgaatccctacatgccaagtgtggtggaaactctggagcaaatgcaaagaaaacatggaggaatgctagtgcgaaatccactttcaagaaattctacccatgaaatgtattgggtttcatgtggaacaggaaacattgtgtcagcagtaaacatgacatccagaatgttgctaaatcgattcacaatggctcacaggaaaccaacatatgaaagagacgtggacctaggcaccggaacaagacatgtggcagtggaaccagaggtagccaacctagatattattggccagaggatagagaacataaaacatgaacacaagtcaacatggcattatgatgaggacaatccatacaaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttgggcaacagagggtgtttaaagagaaagttgacacacgcacaccaaaagcaaaacgaggtacagcacaaatcatggaggtgacagccaggtggttatggggttttctttctagaaacaagaaaccaagaatttgtacaagagaggagttcacaagaaaagttaggtcaaacgcagccatcggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagtttggaaaggcaaaaggaagtcgtgcaatatggtacatgtggttgggagcacgttttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacacgccctactggctaaggcaatcttcaagctaacctaccaaaataaagtggtaagggtacagagaccagcaaaaaatggaaccgtgatggatgttatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagctctcgattggctggaaaaatatggcgtcgaaaggctaaaaagaatggcaatcagtggagatgattgcgtagtgaaaccaattgatgataggtttgcaacagccttaacagctctgaatgatatgggaaaagtaagaaaagatataccacaatgggaaccttcaaaaggatggaatgattggcagcaagtgcctttttgttcacaccacttccaccagctgattatgaaggatgggagggaaatagtggtgccatgccgcaaccaagatgaacttgtgggtagggctagagtatcacaaggtgctggatggagcctgagggaaactgcatgcctaggcaaatcatatgcacaaatgtggcagctgatgtacttccacagaagagacctaagactagccgctaatgctatctgttcagccgttccagttgattgggtcccaactagccgcaccacctggtcgatccatgcccatcaccaatggatgacaacagaagacatgctgtcagtgtggaatagggtttggatagaggaaaacccatggatggaggacaaaacccatatatccagctgggaagatgttccatatttagggaaaagggaagatcaatggtgtggatccctgataggcttaacagcaagggccacctgggccaccaacatacaagtggctataaaccaagtgagaagactaattgggaatgagaattatctagattacatgacatcaatgaagagattcaagaacgagagtgatcccgaaggggcactctggtga

SEQ ID NO: 5735 - RNA, 9879 nt, synthetic construct
  misc_feature 1..9879: note = derived and/or modified CDS sequence (wt) from DENV-1__FJ410204__SS-prME
  source 1..9879: mol_type = other RNA
tctgtgaccatgctccttatgctgatgcctacagccttggcgttccatttgaccacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgctcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattattttcattttgttaatgctggttacaccatccatggccatgcgatgcgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagtttaagtgtgtgacaaaactggaaggaaagatagtccaatatgaaaacttgaaatactcagtaatagtcaccgtccacactggagaccagcaccaggtgggaaatgaaagcacagaacatgggacaactgcaactataacacctcaagctcctacgacggaaatacagctaaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaggtggctgagacccagcatggaaccgttctagtgcagattaaatacgaaggaacagatgcaccatgcaagatccccttttcgacccaagatgagaaaggagtaacccagaatgggagattgataacagccaaccccatagtcactgacaaagaaaaaccagtcaacattgaggcagaaccgccttttggtgagagttacatcgtgataggagcaggtgaaaaagctttgaagctaagctggttcaagaaaggaagcagcatagggaaaatgtttgaggcaactgccagaggagcacgaaggatggccatactgggagacaccgcatgggactttggttctataggaggagtgttcacgtctgttggaaaattaatacaccagatttttggaactgcatatggagttttgttcagcggtgtttcctggaccatgaaaataggaataggggttctgctgacatggctaggattaaactcaaggagcacgtccctttcgatgacgtgcattgcagtcggcctagtaacgctatacttaggagtcatggttcaggcggattcaggatgtgtaattaactggaaaggtagagaactcaaatgtggaagtggcatttttgttaccaatgaagtttatacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaactcacagtggttgtaggagatgttgctgggatcttgggccaagggaaaaaaatgattaggccacaacccatggaatataaatactcgtggaaaagctggggaaaggctaaaatcataggggcagatgcacagaacaccaccttcatcatcgacggcccaaacaccccggaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgagaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgccttcgacaggatggggatgggaacgacgtatctagctctgatggccacttttaaaatgagaccaatgtttgctgtggggctgctattccgcagactaacatccagagaagttcttcttctaacaattggattgagtctagtggcatctgtggagttaccaaattccttggaggagctgggggatggacttgcaatgggcattatgattttaaaattgttgactgactttcaatcacatcagctgtgggctaccttgctgtccttgacatttatcaaaacaacattttctttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatttggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaatatactagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcgaggatcctggaacacgggagaagaagtgcaggtgattgctgttgaaccagggaaaaaccccaaaaatgtacaaacggcgccgggcacctttaagacccctgaaggcgaagttggagccattgctctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgtctcctgtctcccgtgagagttcccaattacaacatgattatcatggatgaagcacattttacagatccatccagcatagcggccagagggtacatctcaacccgagtgggcatgggtgaagcagctgcgatcttcatgacagccactcccccaggatcagtggaggcctttccacagagcaacgcagtcatccaagatgaggaaagagacattcctgagagatcatggaactcaggccatgagtggatcaccgacttcccaggcaaaacagtttggtttgttccaagcattaaatcaggaaatgacattgccaactgcttaagaaagaatgggaagcgggtgattcaattgagcaggaaaacctttgacacagagtaccaaaaaacaaaaaataacgactgggactacgtcgtcacaacagacatctccgaaatgggagcgaatttccgggccgacagggtgatagacccaagacggtgtctgaaaccggtaatactaaaggatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcagtagacggggaatacagactgcgaggtgaagcaaggaaaacgtttgtggagctcatgagaagaggagatctacctgtctggctatcctacaaagttgcttcagaaggcttccagtactctgacagaagatggtgctttgacggggaaaggaacaaccaggtgttggaggagaacatggacgtggagatctggacaaaagaaggagaaacaaagaaactacgacaccgctggccggatgccagacaatactcagacccactgggcctgcgcgagtttaaagagtttgcagcaggaagaagaagcgtctcaggtgatctaatattagaaataggaaaacttccacaacacttgacgcaaagggcccagaatgccttggacaacctggttatgctgcacaattccgaacaaggaggaagagcctatagacatgcaatggaagaactgccagacaccatagaaacgttaatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagtttttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacagcaaacatttccctgacagccattgcaaaccaggcagctatattgatgggacttgacaaaggatggccaatatcgaagatggacataggggttccacttctcgctttggggtgctactcccaggtgaatccactgacgctgacagcggcggtattgatgctagtggcccattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatttagcaggagcaggtctggccttctcattaatgaaatccctaggaggaggtaggagaggcacaggagcccaaggggaaacactgggagagaaatggaaaagacagctgaaccaactgagcaagtcagaattcaacacctataaaaggagtgggattatggaagtggacagatctgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaggtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcttctccaaacccaactatagaggaaggaagaacgctacgcgtcctaaagatggtggagccatggctcagaggaaaccaattctgcataaaaattctgaatccctacatgccaagtgtggtggaaactctggagcaaatgcaaagaaaacatggaggaatgctagtgcgaaatccactttcaagaaattctacccatgaaatgtattgggtttcatgtggaacaggaaacattgtgtcagcagtaaacatgacatccagaatgttgctaaatcgattcacaatggctcacaggaaaccaacatatgaaagagacgtggacctaggcaccggaacaagacatgtggcagtggaaccagaggtagccaacctagatattattggccagaggatagagaacataaaacatgaacacaagtcaacatggcattatgatgaggacaatccatacaaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttgggcaacagagggtgtttaaagagaaagttgacacacgcacaccaaaagcaaaacgaggtacagcacaaatcatggaggtgacagccaggtggttatggggttttctttctagaaacaagaaaccaagaatttgtacaagagaggagttcacaagaaaagttaggtcaaacgcagccatcggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagtttggaaaggcaaaaggaagtcgtgcaatatggtacatgtggttgggagcacgttttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacacgccctactggctaaggcaatcttcaagctaacctaccaaaataaagtggtaagggtacagagaccagcaaaaaatggaaccgtgatggatgttatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagctctcgattggctggaaaaatatggcgtcgaaaggctaaaaagaatggcaatcagtggagatgattgcgtagtgaaaccaattgatgataggtttgcaacagccttaacagctctgaatgatatgggaaaagtaagaaaagatataccacaatgggaaccttcaaaaggatggaatgattggcagcaagtgcctttttgttcacaccacttccaccagctgattatgaaggatgggagggaaatagtggtgccatgccgcaaccaagatgaacttgtgggtagggctagagtatcacaaggtgctggatggagcctgagggaaactgcatgcctaggcaaatcatatgcacaaatgtggcagctgatgtacttccacagaagagacctaagactagccgctaatgctatctgttcagccgttccagttgattgggtcccaactagccgcaccacctggtcgatccatgcccatcaccaatggatgacaacagaagacatgctgtcagtgtggaatagggtttggatagaggaaaacccatggatggaggacaaaacccatatatccagctgggaagatgttccatatttagggaaaagggaagatcaatggtgtggatccctgataggcttaacagcaagggccacctgggccaccaacatacaagtggctataaaccaagtgagaagactaattgggaatgagaattatctagattacatgacatcaatgaagagattcaagaacgagagtgatcccgaaggggcactctggtga

SEQ ID NO: 5736 - RNA, 9879 nt, synthetic construct
  misc_feature 1..9879: note = derived and/or modified CDS sequence (wt) from DENV-1__FJ432742__SS-prME
  source 1..9879: mol_type = other RNA
tctgtgaccatgcttcttatgctgatgcccacagccttggcgttccatctgactacacgagggggagagccgcatatgatagtcaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggatcattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgccgacgaacgtttgtggatagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacaggcaagatttgctggtgacattcaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttctgtaggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggaagagagctcaaatgtggaagtggcatctttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaataccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctccttcatagaagttaaaacatgcatttggccaaaatcccacactctatggagcaatggagttctggaaagtgaaatgataattccaaagatctatggaggaccaatatctcagcacaactacagaccaggatatttcacacaaacagcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacctttacgttttaaaggagaggatgggtgttggtacggcatggaaatcagaccagttaaggaaaaggaagagaatctagtcaaatcaatggtctctgcagggtcaggggaagtggacagcttctcactaggactgctatgcatatcaataatgatcgaagaggtgatgagatccagatggagtagaaaaatgttgatgactggaacactagctgttttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggagatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttataacagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatactagtggaggtccaagatgatggaactatgaagataaaggatgaagagagagatgacacgctaaccattctccttaaagcaactctgctagcagtttcaggggtgtacccattatcaataccagcgaccctttttgtatggtacttctggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacatacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcctccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgctgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgtgagtttaaagagtttgcagcaggaagaagaagcgtctcaggtgatctaatattagaaatagggaagcttccacaacacttgacgcaaagggcccagaatgccttagacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacaggcaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttgggatgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgtagatggaattgttgcaatagacttggaccctgtggtctatgatgcaaaatttgagaaacaactaggccaaataatgttgttaatattatgcacttcacagatcctcttgatgaggaccacatgggccttgtgcgaatccatcacactggccactggacctctgaccacgctttgggagggatctccagggaaattttggaacaccacgatagcggtttccatggcaaacattttcagaggaagttatctagcaggagcaggtctggccttctcactaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggttggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacactcttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggctgtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagagagcttcacaaacagggaaaatgtgccacgtgtgtttacaacatgatggggaagagagagaaaaaactaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgctcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgaccccgaaggggcactctggtga

SEQ ID NO: 5737 - RNA, 9879 nt, synthetic construct
  misc_feature 1..9879: note = derived and/or modified CDS sequence (wt) from DENV-1__FJ410205__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagttacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcccacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtgacccagaatgggagattgataacagctaaccccatagttactgacaaagaaaaaccagttaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgctggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatataaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcactatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcgaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagctatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcataggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaacttagctgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5738 - RNA, 9879 nt, synthetic construct
  misc_feature 1..9879: note = derived and/or modified CDS sequence (wt) from DENV-1__FJ410207__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcatggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgtgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaactagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagtggtgtttcctggaccatgaaaataggaataggagttctgctaacatggctaggattaaactcaaggagcacgtccctttcgatgacatgcattgcagttggcctagtaacattatacctaggagtcatggtccaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccactttcaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacagaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagggcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgagccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcttagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggattgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagttgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatattattgcgccgggctgaagaaagtcacagaagtgaagggatatacgaaaggaggacctggacatgaggagccaattccaatggcgacctatggatggaacctagtaaaactgcactccgggaaagacgtattctttacaccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtctacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttctgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 5739 - RNA, 9879 nt, synthetic construct
  misc_feature 1..9879: note = derived and/or modified CDS sequence (wt) from DENV-1__FJ432744__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttaggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacgagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaattggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaagcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatacctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacatcagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcatggaaaagctggggaaaggctaaaatcataggggcagatgtgcagaatgccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaatactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcattatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattggtggaggtccaagatgatggaaccatgaagataaaggatgaagagagagatgacacgctaaccattctcctgaaagcaactctgctagcagtctcaggggtgtacccattatcaataccagcgaccctttttgtgtggtacttttggcagaaaaagaaacggagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgccttctgtctcccgtgagagttcccaattacaacatgattatcatggatgaagcacatttcaccgatccatccagcatagcggccagagggtacatctcaacccgagtgggtatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaataacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcttatagacatgcaatggaggaactgccagacaccatagaaacgttgatgctcctagctttgatagctgtgttaactggtggagtgacgctgttcttcctatcagggaggggcctagggaaaacatctatcggcctactctgtgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttatttatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgttattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatacaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtctccatggcaaacatttttagaggaagttatctagcaggagcaggtctggccttctcattaatgaaatctctaggaggaggtaggagaggtacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgagttagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagattgatcctgaaggggcactctggtga

SEQ ID NO: 5740 - RNA, 9879 nt, synthetic construct
  misc_feature 1..9879: note = derived and/or modified CDS sequence (wt) from DENV-1__FJ547060__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggatacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagacttcaatgaaatggtgttgttgacaatgaaagaaaaatcatggctagtccataaacaatggtttctagacctaccactgccttggacctcaggagcttcaacatcgcaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagactgataacagctaatcctatagtcactgacaaagaaaaaccagtcaacattgaggcagaaccgccttttggtgagagttacatcgtaataggagcaggtgaaaaagctttgaaactaagctggtttaagaaaggaagtagcatagggaaaatgtttgaggcaactgccagaggagcacgaagaatggccatactgggggacaccgcatgggactttggttctataggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggtctagtaacactatacctaggagtcatggttcaggcggattcaggatgtgtaattaattggaaaggtagagagctaaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggctgaaattgcgtgactcttacacccaagtgtgtgaccatcggctaatgtcggctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtatctagctctgatggccacttttaaaatgagaccaatgtttgctgtcgggctattattccgtagactaacatccagagaagttctccttctcacaattggattgagtctagtggcatctgtggagttaccaaattccttggaggagctgggggatggacttgcaatgggcattatgattttaaaattattgactgactttcagtcacatcagctgtgggctaccttgctgtccttgacatttatcaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttatagcagaaaacaaaatttggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcaccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaaaccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcctacaagggttgtcgcttccgaaatggcagaggcgctcaagggaatgccaataagataccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaggcagctgcgatcttcatgacagccactcccccaggatcagtggaggcctttccacagagcaatgcagttatccaagatgaggaaagagacattcctgagagatcatggaactcaggatatgagtggatcactgactttccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccaatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactccgaccccgctggctggatgccagaacatactcagacccactggccctgcgcgagtttaaagagtttgcagcaggaagaagaagcgtctcaggtgatctaatattagaaatagggaaacttccacaacatttgacgcaaagggcccagaatgccttggacaacctggtcatgttgcacaactccgaacaaggaggaagagcctatagacatgcaatggaagaattgccagacaccatagaaacattgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcggtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgcgaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtgaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcattcccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaatcactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctagtaagacaaatggagtctgagggaatcttttcaccctgcgaattggagattccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatgtaccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggcaacctgggcctctaacatacaagtggccataaaccaagtgagaagactaattgggaatgagaattatctagattacatgacatcaatgaagagattcaagaacgagggtgatcccgaaggggcactctggtga

SEQ ID NO: 5741 - RNA, 9879 nt, synthetic construct
  misc_feature 1..9879: note = derived and/or modified CDS sequence (wt) from DENV-1__FJ432745__SS-prME
  source 1..9879: mol_type = other RNA
tctgtgaccatgctccttatgctgatgcctacagccttggcgttccatttgactacacgagggggagagccgcacatggtagtcagcaagcaggaaagaggaaaatcactcttgttcaagacctcagcaggtgtcaacatgtgtacccttatagcgatggatttgggagagttatgtgaggacacaatgacttacaaatgccctcgaatcactgaagctgaaccagatgacgttgactgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagacaaaccaacattggacattgaactcttgaagacggaagtcacaaaccctgccatcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgttcacaccggagaccagcatcaggtgggaaatgaaagcacagaacatgggacaactgcaactataacacctcaagctcctacgacggaaatacagctgactgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacctggaacagacaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagttactgacaaagaaaaaccagttaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggattaggggttctgctgacatggctaggattaaactcaaggagcacgtccctttcgatgacgtgcattgcagttggcctagtaacactatacttaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccattgggaaggcatgggaggagggtgtgtgtggaattcgatcagcaactcgtctcgagaacgtcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctatacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagcgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcctccttcttataatgggacaattgacatggaatgatctgatcagattatgcatcatggttggagccaacgcttccgacaggatggggatgggaacgacgtacctagctctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcgattgtatctctcttccccttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcacttctcaaaaatgatgtgccgctagctgggccactaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccaccttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtaatccaagatgaggaaagagacattcctgagagatcatggaactcaggctatgagtggatcactgacttcccaggtaaaacagtttggtttgttccaagtattaaatcaggaaatgacatagccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagagggagaaagaaagaaactacgaccccgctggctggatgccagaacatactcagacccactagccctgcgcgagtttaaagagtttgcagcagggagaagaagcgtctcaggtgatctaatattagaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcttatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttagggattggccatgcggctgttggaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacccggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtattctttataccacctgagaaatgtgatacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagatgtggacctaggcgccggaacaagacatgtggcagtggaaccagaggtagctaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagtagagagaattcactcagcggagtggaaggagaaggactccacaaacttggatatatactcagagacatatcaaagattccagggggaaacatgtatgcagatgacacagccggatgggatacaaggataactgaggatgaccttcagaatgaggccagaattactgacatcatggagcccgaacatgccctactggctaagtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtggtgaaaccaattgatgataggtttgcaacagccttaacagctctgaatgatatgggaaaagtgagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattggatcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttagggaaaagggaagatcaatggtgtggatccctgataggcttaacagcaagggccacctgggccaccaacatacaagtggccataaaccaagtgagaagactaattgggaatgagaattacctagattacatgacatcaatgaagagattcaagaacgagagtgaccccgaaggggcactctggtga

SEQ ID NO: 5742 - RNA, 9879 nt, synthetic construct
  misc_feature 1..9879: note = derived and/or modified CDS sequence (wt) from DENV-1__FJ432746__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcatcctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagtccaatatgaaaacttgaaatattcagtaatagtcaccgtccacacaggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggggcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtgacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggcgtttcctggaccatgaaaataggaataggagttctgctgacatggctaggattaaactcaaggagcacgtccctttcgatgacgtgcattgcagttggcctagtaactttatacctaggagtcatggttcaggcggattcaggatgtgtaattaattggaaaggtagagaactcaaatgtggaagtggcatttttgtcactaatgaagttcacacttggacagagcaatacaaatttcaagctgactccccaaagagactatcagcagccatcgggaaggcatgggaggaaggtgtgtgtggaatacgatcagcaactcgtcttgagaacatcatgtggaagcaaatatcaaatgaactgaactacatcttacttgaaaatgacatgaaactcacagtggttgtaggagatgttgctggaatcttggctcaaggaaaaaaaatgattaggccacaacccatggagtacaaatactcgtggaaaagctggggaaaagctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacaccaaggcagttcacgctgacatggggtactggatagaaagtgaaaagaacgagacctggaagttggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgcttcaaaggagaagatgggtgctggtacggtatggaaatcagaccagtcaaggaaaaggaagagaatctagtcaaatcaatggtctctgcagggtcaggggaagtggatagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattttgaaattattgactgattttcaatcacatcagttgtgggctaccttgctgtccttgacatttgtcagaacaacgttttccctgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgtggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcaaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgttctcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaacccaaaaaatgtacaaacagcgccgggcaccttcaagacctctgaaggtgaagttggagccattgccctagattttaaaccaggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtatatctcaacccgagtgggcatgggtgaggcagctgcgatcttcatgacagccactcctccaggatcagtggaggcctttccacagagcaacgcagtcatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcagttgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgaccagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaagaaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagagcccagaatgccttggacaatctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccattatactggagttcttcctgatggtgctgcttattccagagccagacagacaacgcactccgcaggacaaccagctggcatatgtggtgataggtttattattcatgatactgacagtagcagccaatgagatgggactgctggaaaccacaaagaaagacttagggatcggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttctctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagctaaagctaccagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagctactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagtaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattcttcataccacccgagaaatgtgacacccttttgtgtgatattggtgagtcttctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatacgaaagagacgtggatctaggcgccggaacaagacatgtggcagtggaaccagaggtagccaacctagatatcattggccagaggatagagaacataaaacatgaacataagtcaacatggcattatgatgaggacaatccatataaaacatgggcctaccatggatcatatgaggtcaagccgtcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcataaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatctttaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagagactgcatgcctaggcaagtcatatgcacaaatgtggcagctgatgtactttcacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaagtggccataaaccaagtgagaagactacttgggaatgagaattatctagattacatgacatcaatgaagagattcaagaatgagagtgatcctgaaggggcactctggtga

SEQ ID NO: 5743 - RNA, 9879 nt, synthetic construct
  misc_feature 1..9879: note = derived and/or modified CDS sequence (wt) from DENV-1__FJ432748__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttgtgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttttagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgcaaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacccagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaaggtccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggttcaggcggattcaggatgtgtaattaattggaaaggtagagaactcaagtgtggaagtggcatttttgtcaccaatgaagttcacacttggacagagcaatacaaatttcaagctgactcccctaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctcattcatagaagttaaaacatgtatctggccaaaatcccacactctatggagcaatggagttctggaaagtgaaatgataattccaaagatctatggaggaccaatatctcagcacaactacagaccaggatattttacacaagcagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcaaaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtaatgagatccagatggagtagaagaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgttcgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggatacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaatcctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaatatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgctgctcagaggagaggaagaattggaaggaaccacaataaggaaggtgatcagtacatctacatgggacagcctttaaacaacgatgaagatcacgctcactggacagaagcaaaaatgctccttgacaatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggttcgtggagaggaaccttgtgaaaccagaagggaaagtcatagacctcggttgtggaagaggtggctggtcatactattgcgctgggctgaagaaagtcacagaagtgaaggggtatacaaaaggaggacctggacatgaggaaccaatcccaatggcgacctatggatggaacctagtaaagctgcactctgggaaagacgtattttttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5744 - RNA, 9879 nt, synthetic construct
  misc_feature 1..9879: note = derived and/or modified CDS sequence (wt) from DENV-1__FJ432749__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggtgagcaccgacgagacaaacgttccgtcgcactggccccacacgtgggacttggtttggaaacaagaaccgaaacgtggatgtcctctgaaggcgcttggaaacagatacaaagagtggaaacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaaccgcaactataacacctcaagctcccacatcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaggatttgctggtgacattcaagacagctcatgcaaagaagcaggaagtagtcgtactaggatcacaagaaggagcaatgcacactgcgttgaccggagcgacagaaatccaaacgtctggaacgacaacaatctttgcaggacatctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatcccttttttgacccaagatgaaaaaggagtaacccagaatgggagattgataacagctaatcctatagtcactgacaaagaaaaaccagtcaacattgaggcagaaccgccttttggtgagagttacatcgtgataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaagtgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaaacaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagagagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccatggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgcacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgcccctagctgggccactaatagctggaggcatgctaatagcatgttatgttatatctggaagctcagccgacttatcactagagaaagcggctgaggtctcctgggaagaagaagcagaacactctggtgcctcgcacaatatattagtggaggtccaagatgatggaactatgaagataaaggatgaagagagagatgacacgctaaccattctccttaaagcaactctgctggcagtttcaggggtgtacccattatcaataccagcgaccctttttgtgtggtacttttggcagaaaaagaaacagagatctggagtgctatgggacacacctagccctccagaagtggaaaaagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgtacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagtatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactgaaagatggcccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgacaatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattaccagacaccatagaaacgttgatgctcctagctttgatagctgtgttgactggtggagtgacgctgttcttcctatcaggaaggggcctagggaaaacatctatcggcgtactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttgttcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctgaccacgctttgggagggatctccaggaaaattttggaacaccacgatagcggtttccatggcaaatattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatctgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaggtgaagggatatacaaaaggaggacctggacatgaggaaccaatcccaatggcgacctatggatggaacctagtaaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatctgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagctccacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaacagggtttggatagaggaaaacccatggatggaggacaaaacccatgtatccagttggggagatgttccatatctagggaaaagggaagatcagtggtgtggatccctgataggcttaacagcaagggccacctgggcctccaacatacaggtggccataaaccaagtgagaagactaattgggaatgagaattatctagattacatgacatcaatgaagagattcaagaacgagggtgatcccgaaggggcattctggtga

SEQ ID NO: 5745 - RNA, 9879 nt, synthetic construct
  misc_feature 1..9879: note = derived and/or modified CDS sequence (wt) from DENV-1__FJ410212__SS-prME
  source 1..9879: mol_type = other RNA
tctgtgaccatgctccttatgctgatgcctacagccctggcgttccatttgactacacgagggggagagccgcacatgatagtcagcaagcaggaaagaggaaagtcacttttgtttaagacctcagcaggtgtcaatatgtgcacccttatagcgatggatttgggagagttatgtgaggacacaatgacttacaaatgccctcgaatcactgaggcggaaccggatgacgttgattgttggtgcaatgccacagacacatgggtgacctatggaacatgttcccaaactggcgagcaccgacgagaaaaacgttccgtcgcactggccccacacgtgggacttggtttggaaacaagaactgaaacgtggatgtcctctgaaggcgcttggaaacagatacaaagggtggagacttgggccctgagacacccaggattcacggtgatagccctttttctagcacatgccataggaacatctatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctactaacgtgtgctaagttcaagtgtgtgacaaaactggaaggaaagatagttcaatatgaaaacttgaaatattcagtaatagtcaccgtccacactggagaccagcatcaggtgggaaatgaaagcacagaacatgggacaactgcaactataacacctcaagctcccacgacggaaatacagctgaccgactacggagctcttacattggattgttcacctagaacaggactagactttaatgaaatggtgttgttgacaatgaaagaaaaatcatggctagtccacaaacaatggtttctagacttaccactgccttggacttcgggagcttcgacatcacaagagacttggaatagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagactcagcatggaaccgttctagtgcagattaaatatgaaggaacagatgcaccatgcaagattcctttttcgacccaagatgaaaaaggagtaacccagaatgggagattgataacagccaaccccatagtcactgacaaggaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggctctgctgacatggctaggattaaactcaaggagcacgtccctctcgatgacgtgcattgcagttggcctagtaacactatacctaggagtcatggttcaggcggattcaggatgcgtaattaattggaaaggtagagaactcaaatgtggaagtggtatttttgtcaccaatgaagttcacacttggacagagcaatacaaatttcaagctgactccccaaagagactatcagcagccattgggaaggcatgggaggagggtgtgtgtggaattcgatcagcaactcgtctcgagaacatcatgtggaagcaaatatcaaatgaactgaaccacatcttacttgaaaatgacatgaaattcacagtggttgtaggagatgttgctgggatcttggttcaaggaaaaaaaatgattaggccacaacccatggaatacaaatactcgtggaaaagctggggaaaggctaaaatcataggggcagatgtacagaactccaccttcatcattgacggcccaaacaccccagaatgccctgatgaccaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgacatgggctactggatagaaagtgaaaagaacgagacctggaagctggcaagagcctctttcatagaagttaaaacatgcatttggccaaaatcccacactctatggagcaatggagttctggaaagtgaaatgataattccaaagatccatggaggaccaatatctcagcacaactacagaccaggatatttcacacaaacggcagggccgtggcacctaggcaagttggaattggattttgatttgtgtgagggtaccacagtcgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacagttgacatggaatgatctgatcagattatgcatcatggttggagccaacgcttccgacagaatggggatgggaacgacgtacctagctctgatggccacttttaaaatgagaccaatgtttgctgtagggctattattccgcagactaacatccagagaagttcttcttctaacaattggattgagtctagtggcatctgtggagttaccaaattccttggaggagctgggggatggacttgcaatgggcatcatgattttaaaattattgactgactttcaatcatatcagttgtgggctaccttgctgtccttgacatttatcaaaacaacgttttccctgcactatgcatggaagacaatggctatggtactgtcaattgtatctctcttccccttatgcctgtccacgacctcccagaaaacaacatggcttccggtgctattgggatctcttggatgcaaaccactaaccatgtttctaatagcagaaaacaaaatttggggaaggaaaagttggcccctcaatgaagggatcatggctgttggaatagtcagcatcctattaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactcaggtgcctcacacaacatattagtggaggtccaagatgatggaaccatgaagataaaggatgaagagagagatgacacactaaccatcctccttaaagcaactctgctagcagtttcaggggtgtacccattatcaataccagcgaccctttttgtgtggcacttttggcagaaaaagaaacagagatctggagtgttgtgggacacacctagccctccagaagtggaaagagcagttcttgatgatggtatctatagaattatgcagagaggactgttgggcaggtcccaagtaggggtgggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggtttcaaggatcctggaacacgggagaagaagtgcaggtgattgctgttgaaccagggaaaaaccccaaaaatgtacaaacagcgccgggcacctttaagacccctgaaggtgaagttggagccattgccctagatttcaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaagtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgagatggcagaagcgctcaagggaatgccaataaggtaccaaacaacagcagtgaagagtgaacacacaggaaaagagatagttgacctcatgtgtcacgctactttcaccatgcgcctcctgtctcccgtgagagttcccaattacaatatgattatcatggatgaagcacatttcaccgatccatccagcatagcggccagagggtacatctcaacccgagtgggcatgggtgaagcagctgcaatcttcatgacagccactcccccaggatcaatggaggcctttccacagagtaacgcagttatccaagatgaggaaagagacattcctgagagatcatggaactcaggctatgagtggatcactgacttcccaggtaaaacagtctggtttgttccaagcattaaagcaggaaatgacattgccaactgcttaagaaagaatggaaaacgagtgattcaattgagcaggaaaacctttgatacagagtatcaaaaaacaaaaaataacgactgggactacgtcgtcacaacagacatctccgaaatgggagcaaatttccgggccgacagggtgatagacccaagacggtgtctgaaaccggtaatattaaaagatggtccagagcgtgtcattttggcaggaccgatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctctttgagccggagagagaaaagagtgcagcaatagacggggaatatagactgaggggtgaagcaaggaaaacgtttgtggagctcatgagaagaggagacctacccgtctggctgtcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatactagaaatagggaaacttccacaacacttgacgcaaagggcccagaatgccttggacaacttggtcatgttgcacaactccgaacaaggaggaagagcctatagacatgcaatggaagaactgccagacaccatagaaacattgatgctccttgctttgatagctgtgttaactggtggagtgacgctgttcttcctatcaggaaagggcctagggaaaacatctatcggcctactctgcgtgatggcttcaagcgtactactatggatggccagtgtggagccccattggatagcggcctctatcatactggagttcttcctaatggtgttgcttattccagagccagacagacaacgcactccgcaggacaaccagctggcatatgtggtgataggtctgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattgtcactcccatgatgaggcacacaatcgaaaacacaacggcaaacatttccctgacagccattgcaaaccaggcagccatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccattgatggaattgttgcaatagatttggaccctgtggtttatgatgcaaaatttgagaaacaactaggccaaataatgttgttgatactatgcacatcacagatcctcttgatgcggactacatgggccctgtgtgaatccatcacactggccactggacctctgaccacgctttgggagggatctccaggaaaattttggaacaccacgatagcggtttccatggcaaacatttttagaggaagttatctagcaggagcaggtttggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaactgaggtggtttgtggagaggaaccttgtgaaaccagaagggaaagtcatagaccttggttgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattcttcataccacctgagaaatgtgatacccttttgtgtgatattggtgagtcctctccaaacccaactatagaggaaggaagaacgctacgcgttctaaagatggtggaaccatggctcagaggaaaccaattttgcataaagattctgaatccctatatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgaccggttctgggaccttgtgcacagagagagggagcttcacaaacagggaaaatgtgccacgtgtgtttacaacatgatggggaagagagaaaaaaaactaggagagttcggaaaggcaaaaggaagtcgtgcaatatggtacatgtggttgggagcacgctttctagagtttgaagctcttggtttcatgaacgaagatcactggttcagcagagagaattcactcagcggagtggaaggggaaggacttcacaaacttggatatatactcagagacatatcaaagattccagggggaaacatgtatgcagatgacacagccggatgggatacaaggataacagaggatgacctccagaatgaggccaaaattactgacatcatggaacccgaacatgccctactggctaagtcaatcttcaagctaacctaccaaaataaggtggtaagggtacagagaccagcaaaaaatggaaccgtgatggatgtcatatccagacgtgaccagagaggaagtggccaggttggaacctatggcttaaacactttcaccaacatggaagcccagctgataagacaaatggagtctgagggaatctttttacccaacgaattagagaccccaaatttagccgggagagttctcgactggctggaaaaatatggcgtcgaaaggctgaaaagaatggcaatcagcggagatgactgcgtagtgaaaccaattgatgataggttcgcgacagccttaacagctctgaatgatatgggaaaagtaagaaaagacataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagtctgagagaaactgcatgcctaggcaagtcatatgcacaaatgtggcagctgatgtacttccacaggagagacctgagactagccgctaatgctatctgttcagccgttccagtcgactgggtcccaaccagccgcaccacctggtcgatccatgcccatcaccaatggatgacaacagaagacatgctgtcagtgtggaatagggtttggatagaggaaaacccatggatggaggacaaaacccgtatatccagttgggaagatgttccatatctaggaaaaagggaagatcaatggtgtggatctctgataggcttaacagcaagggccacctgggccaccaacatacaagtggccataaaccaagtgagaagactaattgggaatgagaattattcagattacatgacatcaatgaagagattcaagaacgagagtgaacccgaaggggcactctggtga

SEQ ID NO: 5746 - RNA, 9879 nt, synthetic construct
  misc_feature 1..9879: note = derived and/or modified CDS sequence (wt) from DENV-1__FJ461307__SS-prME
  source 1..9879: mol_type = other RNA
tctgtgaccatgctccttatgctgatgcctacagccctggcgttccatttgactacacgagggggagagccgcacatgatagtcagcaagcaggaaagaggaaagtcacttttgtttaagacctcagcaggtgtcaatatgtgcacccttatagcgatggatttgggagagttatgtgaggacacaatgacttacaaatgccctcgaatcactgaggcggaaccggatgacgttgattgttggtgcaatgccacagacacatgggtgacctatggaacatgttcccaaactggcgagcaccgacgagaaaaacgttccgtcgcactggccccacacgtgggacttggtttggaaacaagaactgaaacgtggatgtcctctgaaggcgcttggaaacagatacaaagggtggagacttgggccctgagacacccaggattcacggtgatagccctttttctagcacatgccataggaacatctatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacattggtggaagaacaagacgcgaactttgtgtgtcgacgaacgtttgtggacagaggctggggcaatggctgtgggctcttcggaaaaggaagcctactaacgtgtgctaagttcaagtgtgtgacaaaactggaaggaaagatagttcaatatgaaaacttgaaatattcagtaatagtcaccgtccacactggagaccagcatcaggtgggaaatgaaagcacagaacatgggacaactgcaactataacacctcaagctcccacgacggaaatacagctgaccgactacggagctcttacattggattgttcacctagaacaggactagactttaatgaaatggtgttgttgacaatgaaagaaaaatcatggctagtccacaaacaatggtttctagacttaccactgccttggacttcgggagcttcgacatcacaagagacttggaatagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagactcagcatggaaccgttctagtgcagattaaatatgaaggaacagatgcaccatgcaagattcctttttcgacccaagatgaaaaaggagtaacccagaatgggagattgataacagccaaccccatagtcactgacaaggaaaaaccagtcaatattgaggcagaaccgccttttggtgagagttacatcgtgataggagcaggtgaaaaagctttgaaactaagctggttcaagaaaggaagtagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctctcgatgacgtgcattgcagttggcctagtaacactatacctaggagtcatggttcaggcggattcaggatgcgtaattaattggaaaggtagagaactcaaatgtggaagtggtatctttgtcaccaatgaagttcacacttggacagagcaatacaaatttcaagctgactccccaaagagactatcagcagccattgggaaggcatgggaggagggtgtgtgtggaattcgatcagcaactcgtctcgagaacatcatgtggaagcaaatatcaaatgaactgaaccacatcttacttgaaaatgacatgaaattcacagtggttgtaggagatgttgctgggatcttggttcaaggaaaaaaaatgattaggccacaacccatggaatacaaatactcgtggaaaagctggggaaaggctaaaatcataggggcagatgtacagaactccaccttcatcattgacggcccaaacaccccagaatgccctgatgaccaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgacatgggctactggatagaaagtgaaaagaacgagacctggaagctggcaagagcctctttcatagaagttaaaacatgcatttggccaaaatcccacactctatggagcaatggagttctggaaagtgaaatgataattccaaagatccatggaggaccaatatctcagcacaactacagaccaggatatttcacacaaacggcagggccgtggcacctaggcaagttggaactggattttgatttgtgtgagggtaccacagtcgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacagttgacatggaatgatctgatcagattatgcatcatggttggagccaacgcttccgacagaatggggatgggaacgacgtacctagctctgatggccacttttaaaatgagaccaatgtttgctgtagggctattattccgcagactaacatccagagaagttcttcttctaacaattggattgagtctagtggcatctgtggagttaccaaattccttggaggagctgggggatggacttgcaatgggcatcatgattttaaaattattgactgactttcaatcatatcagttgtgggctaccttgctgtccttgacatttatcaaaacaacgttttccctgcactatgcatggaagacaatggctatggtactgtcaattgtatctctcttccccttatgcctgtccacgacctcccagaaaacaacatggcttccggtgctattgggatctcttggatgcaaaccactaaccatgtttctaatagcagaaaacaaaatttggggaaggaaaagttggcccctcaatgaagggatcatggctgttggaatagtcagcatcctattaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactcaggtgcctcacacaacatattagtggaggtccaagatgatggaaccatgaagataaaggatgaagagagagatgacacactaaccattctccttaaagcaactctgctagcagtttcaggggtgtacccattatcaataccagcgaccctttttgtgtggcacttttggcagaaaaagaaacagagatctggagtgttgtgggacacacctagccctccagaagtggaaagagcagttcttgatgatggtatctatagaattatgcagagaggactgttgggcaggtcccaagtaggggtgggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggtttcaaggatcctggaacacgggagaagaagtgcaggtgattgctgttgaaccagggaaaaaccccaaaaatgtacaaacagcgccgggcacctttaagacccctgaaggtgaagttggagccattgccctagatttcaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaagtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgagatggcagaagcgctcaagggaatgccaataaggtaccaaacaacagcagtgaagagtgaacacacaggaaaagagatagttgacctcatgtgtcacgctactttcaccatgcgcctcctgtctcccgtgagagttcccaattacaatatgattatcatggatgaagcacatttcaccgatccatccagcatagcggccagagggtacatctcaacccgagtgggcatgggtgaagcagctgcaatcttcatgacagccactcccccaggatcaatggaggcctttccacagagtaacgcagttatccaagatgaggaaagagacattcctgagagatcatggaactcaggctatgagtggatcactgacttcccaggtaaaacagtctggtttgttccaagcattaaagcaggaaatgacattgccaactgcttaagaaagaatggaaaacgagtgattcaattgagcaggaaaacctttgatacagagtatcaaaaaacaaaaaataacgactgggactacgtcgtcacaacagacatctccgaaatgggagcaaatttccgggccgacagggtgatagacccaagacggtgtctgaaaccggtaatattaaaagatggtccagagcgtgtcattttggcaggaccgatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctctttgagccggagagagaaaagagtgcagcaatagacggggaatatagactgcggggtgaagcaaggaaaacgtttgtggagctcatgagaagaggagacctacctgtctggctgtcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctagatgccagaacatactcagacccactggccctgcgcgagtttaaagagtttgcagcaggaagaagaagcgtctcaggtgatctaatactagaaatagggaaacttccacaacacttgacgcaaagggcccagaatgccttggacaacttggtcatgttgcacaactccgaacaaggaggaagagcctatagacatgcaatggaagaactgccagacaccatagaaacattgatgctccttgctttgatagctgtgttaactggtggagtgacgctgttcttcctatcaggaaagggcctagggaaaacatctatcggcctactctgcgtgatggcttcaagcgtactactatggatggccagtgtggagccccattggatagcggcctccatcatactggagttcttcctaatggtgttgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagccatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccattgatggaattgttgcaatagatttggaccctgtggtttatgatgcaaaatttgagaaacaactaggccaaataatgttgttgatactatgcacatcacagatcctcttgatgcggactacatgggccctgtgtgaatccatcacactggccactggacctctgaccacgctttgggagggatctccaggaaaattttggaacaccacgatagcggtttccatggcaaacatttttagaggaagttatctagcaggagcaggtttggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaactgaggtggttcgtggagaggaaccttgtgaaaccagaagggaaagtcatagaccttggttgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattcttcataccacctgagaaatgtgatacccttttgtgtgatattggtgagtcctctccaaacccaactatagaggaaggaagaacgctacgcgttctaaagatggtggaaccatggctcagaggaaaccaattttgcataaagattctgaatccctatatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgaccggttctgggaccttgtgcacagagagagggagcttcacaaacagggaaaatgtgccacgtgtgtttacaacatgatggggaagagagaaaaaaaactaggagagttcggaaaggcaaaaggaagtcgtgcaatatggtacatgtggttgggagcacgctttctagagtttgaagctcttggtttcatgaacgaagatcactggttcagcagagagaattcactcagcggagtggaaggggaaggacttcacaaacttggatatatactcagagacatatcaaagattccagggggaaacatgtatgcagatgacacagccggatgggatacaaggataacagaggatgacctccagaatgaggccaaaattactgacatcatggaacccgaacatgccctactggctaagtcaatcttcaagctaacctaccaaaataaggtggtaagggtacagagaccagcaaaaaatggaaccgtgatggatgtcatatccagacgtgaccagagaggaagtggccaggttggaacctatggcttaaacactttcaccaacatggaagcccagctgataagacaaatggagtctgagggaatctttttgcccaacgaattagagaccccaaatctagccgggagagttctcgactggctggaaaaatatggcgtcgaaaggctgaaaagaatggcaatcagcggagatgactgcgtagtgaaaccaattgatgataggttcgcgacagccttaacagctctgaatgatatgggaaaagtaagaaaagacataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgactgggtcccaaccagccgcaccacctggtcgatccatgcccatcaccaatggatgacaacagaagacatgctgtcagtgtggaatagggtttggatagaggaaaacccatggatggaggacaaaacccgtatatccagttgggaagatgttccatatctaggaaaaagggaagatcaatggtgtggatctctgataggcttaacagcaagggccacctgggccaccaacatacaagtggccataaaccaagtgagaagactaattgggaatgagaattattcagattacatgatatcaatgaagagattcaagaacgagagtgaacccgaaggggcactctggtga

SEQ ID NO: 5747 - RNA, 9879 nt, synthetic construct
  misc_feature 1..9879: note = derived and/or modified CDS sequence (wt) from DENV-1__FJ410213__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggatcattttcattttgttaatgctggtaacaccatccatggccatgcgatgcgtgggaataggcagcagggacttcgtggaaggactgtcaggagcaacttgggtagacgtagtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgccgacgaacgtttgtggatagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggttagtccataaacaatggtttctagacctaccactgccttggacctcaggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaacgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttctgtaggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggaagagagctcaaatgtggaagtggcatctttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtgggagatgtagttgggatcttggctcaaggaaaaaaaatgattaggccacaacccatggaacacaaatactcgtggaaaagctggggaaaagctaaaatcataggggcagatgtacagaataccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctccttcatagaagttaaaacatgcatttggccaaaatcccacactctatggagcaatggagttctggaaagtgaaatgataattccaaagatctatggaggaccaatatctcagcacaactacagaccaggatatttcacacaaacagcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacctttacgttttaaaggagaggatgggtgttggtacggcatggaaatcagaccagttaaggaaaaggaagagaatctagtcaaatcaatggtctctgcagggtcaggggaagtggacagcttctcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggagatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttataacagaaaacaaaatctggggaaggaaaagttggcccctcaatgaaggaatcatggctgttggagtagtcagcatcctactaagttcactcctcaaagatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatactagtggaggtccaagatgatggaactatgaagataaaggatgaagagagagatgacacgctaaccattctccttaaagcaactctgctagcagtttcaggggtgtacccattatcaataccagcgaccctttttgtgtggtacttctggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagctattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcctccaggatcagtggaggcctttccacagagcaatgcagttatccaagatgaggaaagagatattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtatcaaaaaacaaaaaataacgattgggactatgtcgttacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgtgagtttaaagagtttgcagcaggaagaagaagcgtctcaggtgatctaatattagaaatagggaagcttccacaacacttgacgcaaagggcccagaatgccttggacaacctggtcatgttgcacaactccgaacaaggaggaagagcctatagacatgcaatggaagaattaccagacaccatagaaacgttgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacaggcaacgcactccgcaggacaatcagctggcgtatgtggtgataggtttgttattcatgatactgacagtagcagccaatgagatgggactactggaaactacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttgggatgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgtagatggaattgttgcaatagatttggaccctgtggtctatgatgcaaaatttgagaaacaactaggccaaataatgttgttaatattatgcacttcacagatcctcttgatgaggaccacatgggccttgtgcgaatccatcacactggccactggacctctgaccacgctttgggagggatctccagggaaattttggaacaccacgatagcggtttccatggcaaacattttcagaggaagttatctagcaggagcaggtctggccttctcactaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgctaaactgaggtggtttgtggagaggaaccttgtgaaaccagaagggaaagtcatagacctcggctgtggaagaggtggttggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacactcttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagagagcttcacaaacagggaaaatgtgccacgtgtgtttacaacatgatggggaagagagagaaaaaactaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagatatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgctcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 5748 - RNA, 9879 nt, synthetic construct
  misc_feature 1..9879: note = derived and/or modified CDS sequence (wt) from DENV-1__FJ461308__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgatgttgattgctggtgcaatgccacagacacatgggtgacctatggaacatgttcccaaactggcgagcaccgacgcgacaaacgttccgtcgcactggccccacacgtgggacttggtttggaaacaagagccgaaacgtggatgtcctctgaaggcgcttggaaacagatacaaagagtggagacttgggccctgagacacccaggattcacggtgatagccctttttctagcacatgccataggaacatccattacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaagggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttgcatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaactagtacaccagatttttggaactgcatatggagttttgttcagcggtgtttcctggactatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgtagctggaatcttggctcaaggaaaaaaaatgattaggccacaacccatggaacacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgcttcaaaggagaggatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctttaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcttgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggcaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagaccatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacctgacgcaaagggcccagaatgccttggacaatctggttatgttgcacaactccgaacaaggaggaagagcctatagacatgcaatggaggaactgccagacaccatagaaacgctgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggccatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgcggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgatacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcgagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagtttgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 5749 - RNA, 9879 nt, synthetic construct
  misc_feature 1..9879: note = derived and/or modified CDS sequence (wt) from DENV-1__FJ461310__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaagctgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgcaaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagatctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctaataacactatacctaggagtcatggttcaggcggattcaggatgtgtaattaattggaaaggtagagaactcaagtgtggaagtggcatttttgtcaccaatgaagttcacacttggacagagcaatacaaatttcaagctgactcccctaagagactatcagcagccattgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctcattcatagaagttaaaacatgtatctggccaaaatcccacactctatggagcaatggagttctggaaagtgaaatgataattccaaagatctatggaggaccaatatctcagcacaactacagaccaggatattttacacaagcagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaagaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgttcgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagctggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagagaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaatcctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcactgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgctcagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatagaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgctgcaatgctggacgtagacttacatccagcttcagcctggaccctctatgcagtggccacaacaattatcactcccatgatgaggcacacaatcgaaaacacaacggcaaacatttccctgacagccattgcaaatcaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggttcgtggagaggaaccttgtgaaaccagaagggaaagtcatagacctcggttgtggaagaggtggctggtcatactattgcgctgggctgaagaaagtcacagaagtgaaggggtatacaaaaggaggacctggacatgaggaaccaatcccaatggcgacctatggatggaacctagtaaagctgcactctgggaaagacgtattttttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcggtgttcgttgatgaaaatcaatggaactcggcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagactacatgacatcaatgaagagattcaagaacgagagtgatcccgaaggggcactctggtga

SEQ ID NO: 5750 - RNA, 9879 nt, synthetic construct
  misc_feature 1..9879: note = derived and/or modified CDS sequence (wt) from DENV-1__FJ906728__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttctgttcaagacctcagcaggtgtcaacatgtgcacccttatagcgatggatttgggagagttatgtgaggacacaatgacttacaaatgtcctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagtttaagtgtgtgacaaaactggaaggaaaaatagtccaatatgaaaacttgaaatactcagtaatagtcaccgtccacactggagaccagcaccaggtgggaaatgaaagcacagaacatgggacaactgcaactataacacctcaagctcctacgacggaaatacagctgaccgactacggagctcttatattggattgttcacctagaacaggactagactttaatgaaatggtgttgttgacaatgaaagaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggcccattcaagctagagaaagaagtggctgagacccagcatggaaccgttctagtgcagattaaatacgaaggaacagatgcaccatgcaagatccccttttcgacccaagatgagaaaggagtaacccagaatgggagattgataacagccaaccccatagtcactgacaaagaaaaaccagtcaacattgaggcagaaccgccttttggtgagagttacatcgtgataggagcaggtgaaaaagctttgaagctaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagtcggcctagtaacgctatacttaggagtcatggttcaggcggattcaggatgtgtaattaactggaaaggtagagaactcaaatgtggaagtggcatttttgttaccaatgaagttcatacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaactcacagtggttgtaggagatgttgctgggatcttgggccaagggaaaaaaatgattaggccacaacccatggaatataaatactcgtggaaaagctggggaaaggctaaaatcataggggcagatgcacagaacaccaccttcattatcgacggcccaaacaccccggaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctcattcatagaagtcaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagttaaggaaaaggaggagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcctccgacaggatggggatgggaacgacgtatctagctctgatggccacttttaaaatgagaccaatgtttgctgtggggctgctactccgcagactaacatccagagaagttcttcttctaacaattggattgagtctagtggcatctgtggagttaccaaattccttggaggagctgggggatggacttgcaatgggcattatgattttaaaattgttgactgactttcaatcacatcagctgtgggctaccttgctgtccttgacatttatcaaaacaacattttctttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatttggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcgaggatcctggaacacgggagaagaagtgcaggtgattgctgttgaaccagggaaaaaccccaaaaatgtacaaacggcgccgggcacctttaagacccctgaaggcgaagttggagccattgctctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgaacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacattttacagatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaacacaggctatgagtggatcaccgacttcccaggcaaaacagtttggtttgttccaagcattaaatcaggaaatgacattgccaactgcctaagaaagaatgggaagcgggtgattcaattgagcaggaaaacctttgacacagagtaccaaaaaacaaaaaataacgactgggactacgtcgtcacaacagacatctccgaaatgggagcgaatttccgggccgacagggtgatagacccaagacggtgtctgaaaccggtaatactaaaggatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcagtagacggggaatacagactgcgaggtgaagcaaggaaaacgtttgtggagctcatgagaagaggagatctacctgtctggctatcctacaaagttgcttcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggttatgctgcacaattccgaacaaggaggaagagcctatagacatgcaatggaagaactgccagacaccatagaaacgttaatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactggcagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacagcaaacatttccctgacagccattgcaaaccaggcagctatattgatgggacttgacaaaggatggccaatatcgaagatggacataggggttccacttctcgctttggggtgctattcccaggtgaatccactgacgctgacagcggcggtattgatgctagtggcccattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatttagcaggagcaggtctggccttctcattaatgaaatctctaggaggaggtaggagaggcacgggagcccaaggggaaacactgggagaaaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaggtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcctctccaaacccaactatagaggaaggaagaacgctacgcgtcctaaagatggtggagccatggctcagaggaaaccaattctgcataaaaattctgaatccctacatgccaagtgtggtggaaactctggagcaaatgcaaagaaaacatggaggaatgctagtgcgaaatccactttcaagaaattctacccatgaaatgtattgggtttcatgtggaacaggaaacattgtgtcagcagtaaacatgacatccagaatgttgctaaatcgattcacaatggctcacaggaaaccaacatatgaaagagacgtggacctaggcaccggaacaagacatgtggcagtggaaccagaggtagccaacctagatattattggccagaggatagagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttgggcaacagagggtgtttaaagagaaagttgacacacgcacaccaaaagcaaaacgaggcacagcacaaatcatggaggtgacagccaggtggttatggggttttctttctagaaacaagaaaccaagaatttgtacaagagaggagttcacaagaaaagttaggtcaaacgcagccatcggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagtttggaaaggcaaaaggaagtcgtgcaatatggtacatgtggttgggagcacgttttctagagttcgaagctcttggtttcatgaatgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgttatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagctctcgattggctggaaaaatatggcgtcgaaaggctaaaaagaatggcaatcagtggagatgattgcgtagtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacaggagagacctaagactagccgctaatgctatctgttcagccgttccagttgattgggtcccaactagccgcaccacctggtcgatccatgcccatcaccaatggatgacaacagaagacatgctgtcagtgtggaatagggtttggatagaggaaaacccatggatggaggacaaaacccatatatccagctgggaagatgttccatatttagggaaaagggaagaccaatggtgtggatccctgataggcttaacagcaagggccacctgggccaccaacatacaagtggctataaaccaagtgagaagactaattgggaatgagaattatctagattacatgacatcaatgaagagattcaagaacgagagtgatcccgaaggggcactctggtga

SEQ ID NO: 5751 - RNA, 9879 nt, synthetic construct
  misc_feature 1..9879: note = derived and/or modified CDS sequence (wt) from DENV-1__FJ461313__SS-prME
  source 1..9879: mol_type = other RNA
tctgtgaccatgctccttatgctgatgcctacagccttggcgttccatttgaccacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagtttaagtgtgtgacaaaactggaaggaaagatagtccaatatgaaaacttgaaatactcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaggtggctgagacccagcatggaaccgttctagtgcagattaaatacgaaggaacagatgcaccatgcaagatccccttttcgacccaagatgagaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagtcggcctagtaacgctatacttaggagccatggttcaggcggattcaggatgtgtaattaactggaaaggtagagaactcaaatgtggaagtggcatttttgttaccaatgaagttcatacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaactcacagtggttgtaggagatgttgctgggatcttgggccaagggaaaaaaatgattaggccacaacccatggaatataaatactcatggaaaagctggggaaaggctaaaatcataggggcagatgcacagaacaccaccttcatcatcgacggcccaaacaccccggaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcctccgacaggatggggatgggaacgacgtatctagctctgatggccacttttaaaatgagaccaatgtttgctgtggggctgctattccgcagactaacatccagagaagttcttcttctaacaattggattgagtctagtggcatctgtggagttaccaaattccttggaggagctgggggatggacttgcaatgggcattatgattttaaaattgttgactgactttcaatcacatcagctgtgggctaccttgctgtccttgacatttatcaaaacaacattttctttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatttggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaggaagcagaacactctggtgcctcacacaacatactagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcgaggatcctggaacacgggagaagaagtgcaggtgattgctgttgaaccagggaaaaaccccaaaaatgtacaaacggcgccgggcacctttaagacccctgaaggcgaagttggagccatagctctagattttaaacccggcacatctggatctcccatcgtgaacagagaaggaaaaatagtaggtctttatggaaatggagtagtgacaacaagtggaacctacgtcagtgccatagcccaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacattttacagatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcaccgacttcccaggcaaaacagtttggtttgttccaagcattaaatcaggaaatgacattgccaactgcttaagaaagaatgggaagcgggtgattcaattgagcaggaaaacctttgacacagagtaccaaaaaacaaaaaataacgactgggactacgtcgtcacaacagacatctccgaaatgggagcgaatttccgggccgacagggtgatagacccaagacggtgtctgaaaccggtaatactaaaggatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcagtagacggggaatacagactgcgaggtgaagcaaggaaaacgtttgtggagctcatgagaagaggagatctacctgtctggctatcctacaaagttgcttcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgtgagtttaaagagtttgcagcaggaagaagaagcgtctcaggtgatctaatattagaaataggaaaacttccacaacacttgacgcaaagggcccagaatgccttggacaacctggttatgctgcacaattccgaacaaggaggaagagcctatagacatgcaatggaagaactgccagacaccatagaaacgttaatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacagcaaacatttccctgacagccattgcaaaccaggcagctatattgatgggacttgacaaaggatggccaatatcgaagatggacataggggttccacttctcgctttggggtgctactcccaggtgaatccactgacgctgacagcggcggtattgatgctagtggcccattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatttagcaggagcaggtctggccttctcattaatgaaatctctaggaggaggtaggagaagcacaggagcccaaggggaaacactgggagagaaatggaaaagacagctgaaccaactgagcaagtcagaattcaacacctataaaaggagtgggattatggaagtggacagatctgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaggtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcctctccaaacccaactatagaggaaggaagaacgctacgcgtcctaaagatggtggagccatggctcagaggaaaccaattctgcataaaaattctgaatccctacatgccaagtgtggtggaaactctggagcaaatgcaaagaaaacatggaggaatgctagtgcgaaatccactttcaagaaattctacccatgaaatgtattgggtttcatgtggaacaggaaacattgtgtcagcagtaaacatgacatccagaatgttgctaaatcgattcacaatggctcacagaaaaccaacatatgaaagagacgtggacctaggcactggaacaagacatgtggcagtggaaccagaggtagccaacctagatattattggccagaggatagagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttgggcaacagagggtgtttaaagagaaagttgacacacgcacaccaaaagcaaaacgaggtacagcacaaatcatggaggtgacagccaggtggttatggggttttctttctagaaacaagaaaccaagaatttgtacaagagaggagttcacaagaaaagttaggtcaaacgcagccatcggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagtttggaaaggcaaaaggaagtcgtgcaatatggtacatgtggttgggagcacgttttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgttatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagctctcaattggctggaaaaatatggcgtcgaaaggctaaaaagaatggcaatcagtggagatgattgcgtagtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacaggagagacctaagactagccgctaatgctatctgttcagccgttccagttgattgggtcccaactagccgcaccacctggtcgatccatgcccatcaccaatggatgacaacagaagacatgctgtcagtgtggaatagggtttggatagaggaaaacccatggatggaggacaaaacccatatatccagctgggaagatgttccatatttagggaaaagggaagatcaatggtgtggatccctgataggcttaacagcaagggccacctgggccaccaacatacaagtggctataaaccaagtgagaagactaattgggaatgagaattatctagattacatgacatcaatgaagagattcaagaacgagagtgatcccgaaggggcactctggtga

SEQ ID NO: 5752 - RNA, 9879 nt, synthetic construct
  misc_feature 1..9879: note = derived and/or modified CDS sequence (wt) from DENV-1__FJ547063__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggttagtccacaaacaatggtttttagacctaccactgccttggacctcgggagcttcaacatcacaagagacttggaacagacaagatctgctggtgacatttaagacagctcatgcaaagaagcaggaagtagtcgtgctaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggcttatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggtacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagcctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatgatactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcttggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgttcaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctaatgtgtcacgccactttcaccatgcgcctcctgtctcccgtaagagttcccaattacaacatgatcatcatggatgaagcacatttcactgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacactacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccacttcaaagaaattctactcatgaaatgtattgggtctcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtagaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacttaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5753 - RNA, 9879 nt, synthetic construct
  misc_feature 1..9879: note = derived and/or modified CDS sequence (wt) from DENV-1__FJ410218__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggatacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagacttcaatgaaatggtgttgttgacaatgaaagaaaaatcatggctagtccacaaacaatggtttctagacctaccactgccctggacctcaggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagactgataacagctaatcctatagtcactgacaaagaaaaaccagtcaacattgaggcagaaccgccttttggtgagagttacatcgtaataggagcaggtgaaaaagctttgaaactaagctggtttaagaaaggaagtagcatagggaaaatgtttgaggcaactgccagaggagcacgaagaatggccatactgggggacaccgcatgggactttggttccataggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggtctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaagggaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacactcaagtgtgtgaccatcggctaatgtcggctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtagatgaacattgtggaaatcgaggaccatctcttagaaccacaacagtcacaggaaagataattcatgaatggtgttgcagatcttgcacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttctcacaattggattgagtctagtggcatctgtggagttaccaaattccttggaggagctgggggatggacttgcaatgggcattatgattttaaaattattgactgactttcagtcacatcagctgtgggctaccttgctgtccttgacatttatcaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttatagtagaaaataaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagccgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcaccgggcaccttcaagacccctgaaggtgaagttggagccattgccctagattttaaacccggcacatctggatctcctatagtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcctacaagggttgtcgcttccgaaatggcagaggcgctcaagggaatgccaataagataccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaggcagctgcgatcttcatgacagccactcccccaggatcagtggaggcctttccacagagcaatgcagttatccaagatgaggaaagagacatccctgagagatcatggaactcaggatatgagtggatcactgactttccaggtaaaacagtctggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccaatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagacctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactccgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacattgatgctcctagctttgatagctgtgttgactggtggagtgacactgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcactacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgcgaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtgaaactgcactccgggaaagacgtattctttacaccacctgagaaatgtgacacccttttgtgtgatattggtgagtcctctccaaacccaaccatagaagaaggaagaacgttgcgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttctagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggattcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaatcactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatcttttcacccagcgaattggagatcccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatgtaccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggcaacctgggcctctaacatacaagtagccataaaccaagtgagaagactaattgggaatgagaattatctagattacatgacatcaatgaagagattcaagaatgagggtgatcccgaaggggcactctggtga

SEQ ID NO: 5754 - RNA, 9879 nt, synthetic construct
  misc_feature 1..9879: note = derived and/or modified CDS sequence (wt) from DENV-1__FJ461316__SS-prME
  source 1..9879: mol_type = other RNA
tctgtgaccatgctccttatgctgatgcctacagccttggcgttccatttgactacacgagggggagagccgcacatggtagtcagcaagcaggaaagaggaaaatcactcttgttcaagacctcagcaggtgtcaacatgtgcacccttatagcgatggatttgggagagttatgtgaggacacaatgacttacaaatgccctcgaatcactgaagctgaaccagatgacgttgactgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagacaaaccaacattggacattgaactcttgaagacggaagtcacaaaccctgccatcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgttcacaccggagaccagcatcaggtgggaaatgaaagcacagaacatgggacaactgcaactataacacctcaagctcctacgacggaaatacagctgactgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacctggaacagacaagatttgctggtgacatttaagacagctcatgcaaagaagcaggaagtagtcgtgctaggatcacaagaaggagcaatgcacactgcgttgaccggagcaacagaaatccaaacgtcaggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggattaggggttctgctgacatggctaggattaaactcaaggagcacgtccctttcgatgacgtgcattgcagttggcctagtaacactatacttaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacgtcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcatgggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctatacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcctccttctcataatgggacaattgacatggaatgatctgatcagattatgcatcatggttggagccaacgcttccgacaggatggggatgggaacgacgtacctagctctgatggccacttttaaaatgagaccgatgtttgctgtagggctattatttcgcagactaacatccagagaggttcttcttctaacaattggattgagtctagtggcatctgtggagttaccaaattccttggaggagctgggggatggacttgcaatgggcattatgattttaaaattattgacagactttcaatcacatcagctgtgggccaccttgctgtccttgacatttatcaaaacaacgttttccttgcactatgcatggaagacaatggctatggtactgtcgattgtatctctcttccccttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcacttctcaaaaatgatgtgccgctagctgggccactaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccatcctccttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcccctaccagagattgaagacgaggtgtttaggaaaagaaacttgacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgcctataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtaatccaagatgaggaaagagacattcctgagagatcatggaactcaggctatgagtggatcactgacttcccaggtaaaacagtttggtttgttccaagtattaaatcaggaaatgacatagccaactgcctaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgaaccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacgaaagagggagaaagaaagaaactacgaccccgctggctggatgccagaacatactcagacccactagccctgcgcgagtttaaagagtttgcagcagggagaagaagcgtctcaggtgatctaatattagaaatagggaaacttccacaacacttgacgcaaagggcccagaatgccctggacaacctggttatgttgcacaactccgaacaaggaggaagagcctacagacatgcaatggaagaactgccagacaccatagaaacgttgatgctcctagctttgatagctgtgttaactggtggagtgacactgttcttcttatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttagggattggccatgcggctgttggaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacccctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagttgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggttgaagaaagtcacagaagtgaagggatatacaaaagggggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagatgtggacctaggcgccggaacaagacatgtggcagtggaaccagaggtagctaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataactgaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtggtgaaaccaattgatgataggtttgcaacagccttaacagctctgaatgatatgggaaaagtgagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattggatcccaaccagccgcaccacctggtcgatccatgcccatcaccaatggatgacaacagaagacatgttgtcagtgtggaatagggtttggatagaggaaaacccatggatggaggacaaaacccatatatccagttggggagatgttccatatttagggaaaagggaagatcaatggtgtggatccctgataggcttaacagcaagggccacctgggccaccaacatacaagtggccataaaccaagtgagaagactaattgggaatgagaattacctagattacatgacatcaatgaagagattcaagaacgagagtgatcccgaaggggcactctggtga

SEQ ID NO: 5755 - RNA, 9879 nt, synthetic construct
  misc_feature 1..9879: note = derived and/or modified CDS sequence (wt) from DENV-1__FJ410220__SS-prME
  source 1..9879: mol_type = other RNA
tctgtgaccatgctccttatgctgatgcctacagccctggcgttccatttgactacacgagggggagagccgcacatgatagtcagcaagcaggaaagaggaaagtcacttttgtttaagacctcagcaggtgtcaatatgtgcacccttatagcgatggatttgggagagttatgtgaggacacaatgacttacaaatgccctcgaatcactgaggcggaaccggatgacgttgattgttggtgcaatgccacagacacatgggtgacctatggaacatgttcccaaactggcgagcaccgacgagaaaaacgttccgtcgcactggccccacacgtgggacttggtttggaaacaagaactgaaacgtggatgtcctctgaaggcgcttggaaacagatacaaagggtggagacttgggccctgagacacccaggattcacggtgatagccctttttctagcacatgccataggaacatctatcacccagaaagggattgttttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacattggtggaagaacaagacgcgaactttgtgtgtcgacgaacgtttgtggacagaggctggggcaatggctgtgggctcttcggaaaaggaagcctactaacgtgtgctaagttcaagtgtgtgacaaaactggaaggaaagatagttcaatatgaaaacttgaaatattcagtaatagtcaccgtccacactggagaccagcatcaggtgggaaatgaaagcacagaacatgggacaactgcaactataacacctcaagctcccacgacggaaatacagctgaccgactacggagctcttacattggattgttcacctagaacaggactagactttaatgaaatggtgttgttgacaatgaaagaaaaatcatggctagtccacaaacaatggtttctagacttaccactgccttggacttcgggagcttcgacatcacaagagacttggaatagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagactcagcatggaaccgttctagtgcagattaaatatgaaggaacagatgcaccatgcaagattcctttttcgacccaagatgaaaaaggagtaacccagaatgggagattgataacagccaaccccatagtcactgacaaggaaaaaccagtcaacattgaggcagaaccgccttttggtgagagttacatcgtgataggagcaggtgaaaaagctttgaaactaagctggttcaagaaaggaagtagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctctcgatgacgtgcattgcagttggcctagtaacactatacctaggagtcatggttcaggcggattcaggatgcgtaattaattggaaaggtagagaactcaaatgtggaagtggtatttttgtcaccaatgaagttcacacttggacagagcaatacaaatttcaagctgactccccaaagagactatcagcagccattgggaaggcatgggaggagggtgtgtgtggaattcgatcagcaactcgtctcgagaacatcatgtggaagcaaatatcaaatgaactgaaccacatcttacttgaaaatgacatgaaattcacagtggttgtaggagatgttgctgggatcttggttcaaggaaaaaaaatgattaggccacaacccatggaatacaaatactcgtggaaaagctggggaaaggctaaaatcataggggcagatgtacagaactccaccttcatcattgacggcccaaacaccccagaatgccctgatgaccaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgacatgggctactggatagaaagtgaaaagaacgagacctggaagctggcaagagcctctttcatagaagttaaaacatgcatttggccaaaatcccacactctatggagcaatggagttctggaaagtgaaatgataattccaaagatccatggaggaccaatatctcagcacaactacagaccaggatatttcacacaaacggcagggccgtggcacctaggcaagttggaactggattttgatttgtgtgagggtaccacagtcgtagtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacagttgacatggaatgatctgatcagattatgcatcatggttggagccaacgcttccgatagaatggggatgggaacgacgtacctagctctgatggccacttttaaaatgagaccaatgtttgctgtagggctattattccgcagactaacatccagagaagttcttcttctaacaattggattgagtctagtggcatctgtggagttaccaaattccttggaggagctgggggatggacttgcaatgggcatcatgattttaaaattattgactgactttcaatcatatcagttgtgggctaccttgctgtccttgacatttatcaaaacaacgttttccctgcactatgcatggaagacaatggctatggtactgtcaattgtatctctcttccccttatgcctgtccacgacctcccagaaaacaacatggcttccggtgctattgggatctcttggatgcaaaccactaaccatgtttctaatagcagaaaacaaaatttggggaaggaaaagttggcccctcaatgaagggatcatggctgttggaatagtcagcatcctattaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactcaggtgcctcacacaacatattagtggaggtccaagatgatggaaccatgaagataaaggatgaagagagagatgacacactaaccattctccttaaagcaactctgctagcagtttcaggggtgtacccattatcaataccagcgaccctttttgtgtggcacttttggcagaaaaagaaacagagatctggagtgttgtgggacacacctagccctccagaagtggaaagagcagttcttgatgatggtatctatagaattatgcagagaggactgttgggcaggtcccaagtaggggtgggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggtttcaaggatcctggaacacgggagaagaagtgcaggtgattgctgttgaaccagggaaaaaccccaaaaatgtacaaacagcgccgggcacctttaagacccctgaaggtgaagttggagccattgccctagatttcaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaagtgtttaggaaaaggaacttaacaataatggacctacatccaggatcggggaaaacaagaagatatcttccagccatagtccgtgaggccataaaaaggaagctgcgcacactaattctggctcccacaagggttgtcgcttccgagatggcagaagcgctcaagggaatgccaataaggtaccaaacaacagcagtgaagagtgaacacacaggaaaagagatagttgacctcatgtgtcacgctactttcaccatgcgcctcctgtctcccgttagagttcccaattacaatatgattatcatggatgaagcacatttcaccgatccatccagcatagcggccagagggtacatctcaacccgagtgggcatgggtgaagcagctgcaatcttcatgacagccactcccccaggatcaatggaggcctttccacagagtaacgcagttatccaagatgaggaaagagacattcctgagagatcatggaactcaggctatgagtggatcactgacttcccaggtaaaacagtctggtttgttccaagcattaaagcaggaaatgacattgccaactgcttaagaaagaatggaaaacgagtgattcaattgagcaggaaaacctttgatacagagtatcaaaaaacaaaaaataacgactgggactacgtcgtcacaacagacatctccgaaatgggagcaaatttccgggccgacagggtgatagacccaagacggtgtctgaaaccggtaatattaaaagatggtccagagcgtgtcattttggcaggaccgatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctctttgagccggagagagaaaagagtgcagcaatagacggggaatatagactgcggggtgaagcaaggaaaacgtttgtggagctcatgagaagaggagacctacctgtctggctgtcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatactagaaatagggaaacttccacaacacttgacgcaaagggcccagaatgccttggacaacttggtcatgttgcacaactccgaacaaggaggaagagcctatagacatgcaatggaagaactgccagacaccatagaaacattgatgctccttgctttgatagctgtgttaactggtggagtgacgctgttcttcctatcaggaaaaggcctagggaaaacatctatcggcctactctgcgtgatggcttcaagcgtactactatggatggccagtgtggagccccattggatagcggcctccatcatactggagttcttcctaatggtgttgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagccatattgatgggacttgacaaaggatggccaatatcgaagatggatataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccattgatggaattgttgcaatagatttggaccctgtggtttatgatgcaaaatttgagaaacaactaggccaaataatgttgttgatactatgcacatcacagatcctcttgatgcggactacatgggccctgtgtgaatctatcacactggccactggacctctgaccacgctttgggagggatctccaggaaaattttggaacaccacgatagcggtttccatggcaaacatttttagaggaagttatctagcaggagcaggtttggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaactgaggtggtttgtggagaggaaccttgtgaaaccagaagggaaagtcatagaccttggttgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattcttcataccacctgagaaatgtgatacccttttgtgtgatattggtgagtcctctccaaacccaactatagaggaaggaagaacgctacgcgttctaaagatggtggaaccatggctcagaggaaaccaattttgcataaagattctgaatccctatatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgaccggttctgggaccttgtgcacagagagagggagcttcacaaacagggaaaatgtgccacgtgtgtttacaacatgatggggaagagagaaaaaaaactaggagagttcggaaaggcaaaaggaagtcgtgcaatatggtacatgtggttgggagcacgctttctagagtttgaagctcttggtttcatgaacgaagatcactggttcagcagagagaattcactcagcggagtggaaggggaaggacttcacaaacttggatatatactcagagacatatcaaagattccaggaggaaacatgtatgcagatgacacagccggatgggatacaaggataacagaggatgacctccagaatgaggccaaaattactgacatcatggaacccgaacatgccctactggctaagtcaatcttcaagctaacctaccaaaataaggtggtaagggtacagagaccagcaaaaaatggaaccgtgatggatgtcatatccagacgtgaccagagaggaagtggccaggttggaacctatggcttaaacactttcaccaacatggaagcccagctgataagacaaatggagtctgagggaatctttttacccaacgaattagagaccccaaatttagccgggagagttctcgactggctggaaaaatatggcgtcgaaaggctgaaaagaatggcaatcagcggagatgactgcgtagtgaaaccaattgatgataggttcgcgacagccttaacagctctgaatgatatgggaaaagtaagaaaagacataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgactgggtcccaaccagccgcaccacctggtcgatccatgcccatcaccaatggatgacaacagaagacatgctgtcagtgtggaatagggtttggatagaggaaaacccatggatggaggacaaaacccgtatatccagttgggaagatgttccatatctaggaaaaagggaagatcaatggtgtggatctctgataggcttaacagcaagggccacctgggccaccaacatacaagtggccataaaccaagtgagaagactaattgggaatgagaattattcagattacatgacatcaatgaagagattcaagaacgagagtgaacccgaaggggcactctggtga

SEQ ID NO: 5756 - RNA, 9879 nt, synthetic construct
  misc_feature 1..9879: note = derived and/or modified CDS sequence (wt) from DENV-1__JF937649__SS-prME
  source 1..9879: mol_type = other RNA
tctgtgaccatgctccttatgctgatgcctacagccttggcattccatttgactacacgaggaggagagccgcacatgatagttagcaagcaggaaagaggaaagtcacttttgttcaagacctcagcaggtgttaacatgtgcaccctcatagcgatggatttgggagagttatgtgaggacacaatgacttacaaatgtcctcgaattactgaggtggaaccagatgacgttgattgttggtgcaacaccacagacacatgggtgacctatggaacatgttcccaaactggcgagcaccgacgagacaagcgttccgtcgcactggccccacacgtgggacttggtttagaaacaagagccgaaacgtggatgtcctctgaaggcgcttggaaacagatacaaaaagtggagacttgggctctgagacacccaggattcacggtgatagccctttttctagcacatgccataggaacatccatcacccagaaagggattattttcattctgttaatgctggtgacaccttccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacattggtggaagaacaagacgcgaactttgtgtgccgacgaacgttcgtggacagaggctggggcaatggctgtgggctcttcggaaaaggaagcctgataacgtgtgctaagttcaagtgtgtgacaaaactggaaggaaagatagttcaatatgaaaatttgaaatattcagtaatagtcaccgtccacactggagaccagcaccaggtgggaaatgagagcacagaacatgggacaactgcaactataacacctcaagctcctacgtcggaaatacagctgaccgactacggagctcttacattggactgctcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtccggaacgacaacaatttttgcaggacacctgaaatgtagactaaagatggacaaactgactctaaaagggatgtcatatgtgatgtgcacaggttcattcaagctagagaaagaagtggctgagacccagcatggaaccgttttagtgcagattaaatacgaaggaacagatgcaccatgcaagatccctttttcgacccaagatgaaaaaggagtaacccagaacgggagattgataacagctaaccccatagtcactgacaaagaaaaaccagtcaacattgaggcagaaccgccttttggtgagagttacatcgtgataggagcaggcgaaaaagctttgaaactaagctggttcaagaaaggaagcagcatagggaaaatgtttgaggcaactgccagaggagcacgaaggatggccatattgggagataccgcatgggactttggttctataggaggagtgttcacgtctgttggaaaactagtacaccagatttttggaactgcatatggagttttgttcagcggtgtttcctggaccatgaagataggaataggggttctgctgacatggctaggattaaactcaaggagcacgtccctttcgatgacgtgcattgcagttggtctagtaacactatacctaggagtcatggttcaggcggattcaggatgtgtgattaattggaagggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccacccgtctcgagaatatcatgtggaggcaaatatcaaatgaactgaaccacatcttacttgaaaatgacatgaaattcacagtagttgtaggagatgttgttgggatcttggctcaaggaaaaaagatgattaggccacaacccatggaacacaaatactcgtggaaaagctggggaaaagctaaaatcataggggcagatgtacagaacaccaccttcatcatcgatggcccaaacaccccagaatgccctgatgatcaaagagcatggaacatttgggaagttgaggactatggatttggaattttcacgacaaacatatggctgaaattacgtgactcctacacccaagtgtgtgaccaccggctaatgtcagctgccatcaaggacagcaaggcagttcacgctgatatggggtactggatagaaagtgaaaagaatgagacctggaagctggcaagagcctcttttatagaagttaaaacatgcatctggccaaaatcccacaccctatggagcaatggagttctggaaagtgaaatgataattccaaaaatctatggaggaccaatatctcagcacaactatagaccaggatatttcacacaaacggcagggccgtggcacctaggcaagttggaactggattttgatttatgtgagggtaccacagttgttgtggatgaacattgtggaaatcgaggaccatctcttagaaccacaacagtcacaggaaagataattcatgaatggtgttgcagatcttgcacgctaccacccttacgtttcaaaggagaagatgggtgttggtacggtatggaaatcagaccagtcaaggaaaaggaagagaatctagtcaaatcaatggtctcagcagggtcaggggaagtggacagcttttcactaggactgttatgcatatcaataatgatcgaagaggtgatgagatccagatggagtagaaaaatgctgatgactggaacactggctgtgttcttccttctcataatgggacaattgacatggaatgatctgatcaggtcatgcatcatggttggagccaacgcttccgacaggatggggatgggaacgacgtatctagctttgatggccacttttaaaatgagaccaatgtttgctgtcgggctattattccgcagactaacatccagagaagttcttcttctaacaattggattgagtctagtggcatctgtggagttaccaaattccttggaggagctgggggatggacttgcaatgggcattatgattttaaaattattgactgattttcagtcatatcagctgtgggctaccttgctgtccttgacatttatcaaaacaacgttttccttgcactatgcatggaagacaatggctatggtattgtcaattgtatctctcctccccttatgcctgtccacgacctcccaaaaaacaacatggctcccggtgctattgggatctcttggatgcaaaccactaaccatgtttctaatagcagaaaacaaaatctggggaaggaaaagttggcccctcaatgaaggaatcatggctgttggcatagtcagcatcctactaagttcactcctcaaaaatgatgtgccgctagctgggccactaatagctggaggcatgctaatagcatgttatgttatatcaggaagctcagccgacctatcactagagaaagcggctgaggtctcttgggaagaagaagcagaacactctggtgcctcacataacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcaccttcaagacccctgaaggtgaagttggagccattgccttagatttcaaacccggcacatctggatctcctatcgtgaacagagaagggaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcgggaaaaacaagaagatatcttccagccatagtccgtgaggccataaaaaggaagctgcgcacactaattttggctcccacaagggttgtcgcttccgaaatggcagaggcgctcaaggggatgccaataaggtaccaaacaacagcagtgaagagtgaacacacaggaagagagatagttgatcttatgtgtcacgccactttcaccatgcgtctcctgtctcctgtgagagttcccaattacaacatgattatcatggatgaagcacatttcaccgatccatccagcatagcggccagaggatacatctcaacccgagtgggcatgggtgaagcagctgcgatcttcatgacagccactcccccaggatcggtggaagcctttccacagagcaatgcagttatccaagatgaagaaagagacattcctgaaagatcatggaactcaggctatgagtggatcactgacttcccaggtaaaacagtttggtttgttccaagcatcaaatcaggaaatgacattgccaactgcctaagaaagaatgggaaacgggtgattcaattgagcaggaaaacctttgatacagagtaccaaaagacaaaaaataacgactgggactacgtcgttacaacagacatctccgaaatgggagcaaacttccgggctgacagggtgatagacccaagacggtgtctgaaaccggtaatactaaaagatggtccagagcgtgtcatcttagcaggaccgatgccagtgactgtggccagtgccgcccagaggagaggaagaattggaaggaaccacaataaggaaggtgatcagtacatctacatgggacagcccttaaacaacgatgaagatcacgcccactggacagaagcaaaaatgctccttgataatataaacacaccagaagggattatcccagccctcttcgaaccggagagagaaaagagtgcagcaatagacggggaatacagactgcggggtgaagcaaggaaaacgtttgtggagctcatgagaagaggagatctacctgtctggttatcctacaaagtcgcctcagaaggcttccagtactccgacagaagatggtgctttgacggggaaaggaacaaccaggtgttggaggagaacatggacgtggagatctggacaaaagaaggagaaagaaagaaactacgaccccgctggctagatgccagaacatactcagacccactggccctgcgcgagtttaaagagtttgcagcaggaagaagaagcgtctcaggtgatttaatactagaaatagggaaacttccacaacacttgacgcaaagggcccagaatgctttggacaacctggtcatgttgcacaactccgaacaaggaggaagagcctatagacatgcaatggaagaactgccagacactatagaaacgttgatgctcctagctttgatagctgtgttgactggtggagtgacgctgttctttctatcaggaaagggcctagggaaaacatctatcggcctactctgcgtgatggcttcaagcgcactgctatggatggccagtgtggagccccattggatagcggcctccatcatactggagttcttcttgatggtgctgcttattccagagccagacagacaacgcactccgcaagacaaccagctggcatatgtggtgataggtttgttatttatgatacttacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagccatattgatgggacttgacaaaggatggccaatatcgaagatggacataggagttccacttctagccttggggtgctattcccaagtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattctggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctacaaaaggagtgggataatggaagtggacagatccgaagccaaagagggactaagaagaggagaaacaaccaaacatgcagtgtcgagaggaaccgccaaactgaggtggtttgtggagaggaatcttgtgaaaccagaagggaaagtcatagacctcggttgtggaagaggtggctggtcatactattgcgctgggctgaagaaagtcacagaagtgaagggatacacaaaaggaggacccggacatgaggaaccaatcccaatggcgacctatggatggaacctagtaaagctgcactccgggaaagacgtattctttataccacctgagaaatgtgacacccttttgtgtgatattggtgaatcctctccaaacccaactatagaggaaggaagaacgttacgcgtcctaaagatggtggaaccatggctcagaggaaaccaattctgcataaagattctgaatccctacatgccaagtgtggtggaaaccctggaacaaatgcaaagaaaacatggaggaatgctagtgcgaaatccactttcaagaaattctacccatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaacaagacatgtggcagtggaaccagaggtagccaatctggatatcattggccagaggatagagaacataaaacatgaacacaagtcaacatggcattatgatgaggataatccatataaaacatgggcctatcatggatcatatgaggtcaagccatcaggatcagcctcatccatggttaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcactgcacaaatcatggaggtgacagccaggtggttatggggctttctttccagaaacaaaaaaccaagaatttgtacaagagaggagttcacaagaaaagttaggtcaaacgcagccattggagcagtgttcgttgatgaaaatcaatggaactcagcaaaagaagcggtggaagatgaacggttctgggaccttgtgcacagagagagggagcttcacaaacagggaaaatgcgccacgtgtgtttacaacatgatggggaagagagagaaaaagctaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaactcggatacatactcagagacatatcaaagattcctgggggaaatatgtatgcagatgacacagctggatgggatacaaggataacagaggatgaccttcagaatgaggccaaaattactgacatcatggagcctgaacatgccctactggctacgtcaatcttcaagctgacctaccaaaataaggtggtaagggtacagagaccagcaagaaatggaaccgtgatggatgtcatatccagacgtgaccagagaggaagtggccaggtcggaacttatggcttaaacactttcaccaacatggaagcccagcttataagacaaatggagtctgagggaatcttttcacccagcgagttggagaccccaaatttagccgagagagttctcgactggctggaaaaacatggcgtcgaaaggctaaaaagaatggcaatcagcggagatgactgcgtggtgaaaccaattgatgacaggtttgcaacagccttatcagctctgaatgatatgggaaaagtaagaaaagatataccacaatgggaaccctcaaaaggatggaatgattggcaacaagtgcctttttgttcacaccacttccaccagctgattatgaaggatggaagggaaatagtggtgccatgccgcaaccaagatgaacttgtgggtagggctagagtatcacaaggtgctggatggagcctgagagaaactgcatgcctaggcaagtcatatgcacaaatgtggcaactgatgtacttccacaggagagacctgagactagccgctaatgctatctgttcagccgttccagttgattgggtcccaaccagccgtaccacctggtcgatccatgcccatcaccaatggatgacaacagaagacatgttgtcagtgtggaatagggtttggatagaggaaaacccatggatggaggacaaaacccatatatccagctggggagatgttccatatttaggaaaaagggaagatcagtggtgtggatccctgataggcttaacagcaagggccacctgggccaccaacatacaagtggccataaaccaagtgagaagactaattgggaatgagaattatttagattacatgacatcaatgaagagattcaagaacgagagtgatcctgaaggggcactctggtga

SEQ ID NO: 5757 - RNA, 9879 nt, synthetic construct
  misc_feature 1..9879: note = derived and/or modified CDS sequence (wt) from DENV-1__FJ410222__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactatggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactgagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatctttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacaggccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagcagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatcactcctccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcttactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtatttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaacctgaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaatcactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccaagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5758 - RNA, 9879 nt, synthetic construct
  misc_feature 1..9879: note = derived and/or modified CDS sequence (wt) from DENV-1__FJ461319__SS-prME
  source 1..9879: mol_type = other RNA
tctgtgaccatgctccttatgctgatgcctacagccttggcgttccatttgaccacacgagggggagagccgcacatggtagtcagcaagcaggaaagaggaaaatcactcttgttcaagacctcagcaggtgtcaacatgtgtacccttatagcgatggatctgggagagttatgtgaggacacaatgacttacaaatgccctcgaatcactgaagctgaaccagatgacgttgactgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagacaaaccaacattggacattgaactcttgaagacggaagtcacaaaccctgccatcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgttcacaccggagaccagcatcaggtgggaaatgaaagcacagaacatgggacaactgcaactataacacctcaagctcctacgacggaaatacagctgactgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacctggaacagacaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggattaggggttctgctgacatggctaggattaaactcaaggagcacgtccctttcgatgacgtgcattgcagttggcctagtaacactatacttaggagtcatggttcaggcggattcaggatgtgtaattaattggaaaggtagagaactcaaatgtggaagtggcatttttgtcaccaatgaagtccacacctggacagagcaatacaaatttcaagctgactccccaaagagactatcagcagccatcgggaaggcatgggaggagggtgtgtgtggaattcgatcagcaactcgtctcgagaacgtcatgtggaagcaaatatcaaatgaactgaatcacatcttacttgaaaatgatatgaaattcacagtggttgtaggagatgttgctgggatcttggctcaaggaaagaaaatgattaggccacaacccatggaacacaaatactcgtggaaaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcctccttctcataatgggacaattgacatggaatgatctgatcagattatgcatcatggttggagccaacgcttccgacaggatggggatgggaacgacgtacctagctctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcgattgtatctctcttccccttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcacttctcaaaaatgatgtgccgctagctgggccactaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggccactaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccaccttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtaatccaagatgaggaaagagacattcctgagagatcatggaactcaggctatgagtggatcactgacttcccaggtaaaacagtttggtttgttccaagtattaaatcaggaaatgacatagccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagagggagaaagaaagaaactacgaccccgctggctggatgccagaacatactcagacccactagccctgcgcgagtttaaagagtttgcagcagggagaagaagcgtctcaggtgatctaatattagaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcttatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttagggattggccatgcggctgttggaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccgcaggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaagagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtattctttataccacctgagaaatgtgatacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagatgtggacctaggcgccggaacaagacatgtggcagtggaaccagaggtagctaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagtagagagaattcactcagcggagtggaaggagaaggactccacaaacttggatatatactcagagacatatcaaagattccagggggaaacatgtatgcagatgacacagccggatgggacacaaggataactgaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtggtgaaaccaattgatgataggtttgcaacagccttaacagctctgaatgatatgggaaaagtgagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattggatcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttagggaaaagggaagatcaatggtgtggatccctgataggcttaacagcaagggccacctgggccaccaacgtacaagtggccataaaccaagtgagaagactaattgggaatgagaattacctagattacatgacatcaatgaagagattcaagaacgagagtgatcccgaaggggcactctggtga

SEQ ID NO: 5759 - RNA, 9879 nt, synthetic construct
  misc_feature 1..9879: note = derived and/or modified CDS sequence (wt) from DENV-1__FJ461320__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaacttttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggatagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttctgtaggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatctttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggacccatatctcagcacaactacagaccaggatacttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggcatggaaatcagaccagttaaggaaaaggaagagaatctagtcaaatcaatggtctccgcagggtcaggggaagtggacagcttctcactaggactgctatgcatatcaataatggtcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaataagaccaatgtttgctgtcgggctattattccgtagactaacatccagagaagttctccttcttacaattggattgagtctagtggcatctgtggagttaccaaattccttggaggagctgggagatggacttgcaatgggcattatgattttaaaattattgactgactttcagtcacaccagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttataacagaaaacaaaatctggggaaggaaaagttggcccctcaatgaaggaatcatggctgttggagtagtcagcattctactaagttcactccttaaaaatgatgtgccgctagctgggccactaatagctggaggcatgctaatagcgtgttatgttatatctggaagctcagccgacttatcactagagaaagcggctgaggtctcctgggaagaagaagcagaacactctggtgcctcgcacaatatactagtggaggtccaagatgatggaactatgaagataaaggatgaagagagagatgacacgctaaccattctccttaaagcaactctgctagcagtttcaggggtgtacccattatcaataccagcgaccctttttgtgtggtacttctggcagaaaaagaaacagagatctggagtgctatgggacacacctagccctccagaagtggaaagagcagttcttgatgatggtatctatagaatcatgcagagaggactgttgggcagatcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcagggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattattatggatgaagcacatttcaccgatccatccagtatagcagccagagggtacatctcaacccgagtgggcatgggtgaagcagctgcgatcttcatgacagccactcctccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaaggggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgtgagtttaaagagtttgcagcaggaagaagaagcgtctcaggtgatctaatattagaaatagggaagcttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtggcagccaatgagatgggactactggaaaccacaaagaaagacttagggattggccatgtggctgttgaaaatcaccaccatgccacaatgctggacgtagacttacatccagcttcagcctggaccctctatgcagtggccacgacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttgggatgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatattatgcacttcacagatcctcttgatgaggactacatgggccttgtgcgaatccatcacactggccactggacctttgaccacgctttgggagggatctccaggaaaattttggaacaccacgatagcggtttccatggcaaatattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaggagaaagttgacacgcgcacaccaaaagcaaaacgaggcacagcacaaatcatggaggtgacagccagatggttatggggttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagagagcttcacaaacagggaaaatgtgccacgtgtgtttacaacatgatggggaagagagagaaaaaactaggagagttcggaaaggcaaaaggaagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttacggcttaaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgctcagccgttccagttgattgggtcccaaccagtcgcactacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 5760 - RNA, 9879 nt, synthetic construct
  misc_feature 1..9879: note = derived and/or modified CDS sequence (wt) from DENV-1__FJ410225__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgcaaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctattggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggttcaggcggattcaggatgtgtaattaattggaaaggtagagaactcaagtgtggaagtggcatttttgtcaccaatgaagttcacacttggacagagcaatacaaatttcaagctgactcccctaagagactatcagcagccatcgggaaggcatgggaggagggtgtgtgtggaattcgatcagcaactcgtctcgagaacatcatgtggaagcaaatatcgaatgaactgaatcacatcttacttgaaaatgatatgaaattcacagtggttgtaggagatgttgctgggatcttggctcaaggaaagaaaatgattaggccacaacccatggaatacaaatattcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctcattcatagaagttaaaacatgtatctggccaaaatcccacactctatggagcaatggagttctggaaagtgaaatgataattccaaagatctatggaggaccaatatctcagcacaactacagaccaggatattttacacaagcagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcattaggactgctatgcatatcaataatgatcgaggaggtgatgagatccagatggagtagaagaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgttcgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgagatctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaatcctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgcaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgctcagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggttcgtggagaggaaccttgtgaaaccagaagggaaagtcatagacctcggttgtggaagaggtggctggtcatactattgcgctgggctgaagaaagtcacagaagtgaaggggtatacaaaaggaggacctggacatgaggaaccaatcccaatggcgacctatggatggaacctagtaaagctgcactctgggaaagacgtattttttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5761 - RNA, 9879 nt, synthetic construct
  misc_feature 1..9879: note = derived and/or modified CDS sequence (wt) from DENV-1__FJ410226__SS-prME
  source 1..9879: mol_type = other RNA
tctgtgaccatgctcctcatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactagaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgcccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggttcctagacttaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggataagctgactctaaaggggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagacaaaccagtcaacattgaggcagaaccgccttttggtgagagctacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgtttacgtctgttggaaaattagtacaccagatttttggaactgcatatggagttttgttcagcggtgtttcttggaccatgaaaataggaataggagttctgctaacatggctaggattaaactcaaggagcacgtccctttcgatgacgtgcattgcagttggcctagtaacattatacctaggagtcatggttcaggcggattcaggatgtgtagttaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgccgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaactgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtgcttcttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcatgtccacaacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgttagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagacgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaggacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacacccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagtaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacgtctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatttggttatgttgcacaactccgaacaaggaggaagagcctatagacacgcaatggaggaattgccagacaccatagaaacgttgatgctcctagctttgatagctgtgttaactggtggagtgacgctgttcttcctatcaggaagaggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatacgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaatattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtacgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagctaacctagatatcattggccagaggatagagaacataaaacatgaacataagtcaacatggcattatgatgaggacaatccatacaaaacatgggcctaccatggatcatatgaggtcaagccatcaggatcagcctcatccatggttaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttctgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatacttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 5762 - RNA, 9879 nt, synthetic construct
  misc_feature 1..9879: note = derived and/or modified CDS sequence (wt) from DENV-1__FJ410227__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagcccttttcctagcacatgccataggaacatccatcacccagaaagggatcattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacattcaagacagctcatgcaaagaagcaggaagtagtcgtactaggatcacaagaaggagcaatgcacactgcgttgaccggagcaacagaaatccaaacgtctggaacgacaacaatttttgcaggacatttgaaatgcagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggcgtgtgtggaatacgatcaacaactcgtctcgagaacatcatgtggaagcaaatatcaaatgaactgaaccacatcttacttgaaaatgacatgaaattcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtactacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagctcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacaaagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtgaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgttagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgtctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactacggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgctgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttacaaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagaccttggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaatccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcgattctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggcttcatgaacgaagatcactggttcagcagagagaattcactcagcggagtggaaggagaaggactccacaaacttggatacatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaactcacatatccagttggggagatgttccatatttaggaaaaagggaagatcaatggtgtggatccctgataggcttgacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5763 - RNA, 9879 nt, synthetic construct
  misc_feature 1..9879: note = derived and/or modified CDS sequence (wt) from DENV-1__FJ859029__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaaaagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaattgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagtccaacatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggttagtccacaaacaatggtttctagacctaccactgccttggacctcgggagcttcaacatcacaagagacttggaacagaaaagatctgctggtgacatttaagacagctcatgcaaagaagcaggaagtagtcgtgctaggatcacaagaaggagcaatgcacactgcgttgaccggagcaacagaaatccaaacgtctggaacgacaacaatttttgcaggacacttgaaatgtagactaaagatggacaagctgactctaaaagggacgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcctccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaactccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcattctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggagtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccaggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagttcgtgaggccataaaaaggaagctgcgcacattaattctggctcccacaagggttgtcgcttccgaaatggcagaggcgctcaagggaatgccaataaggtaccaaacaacagcagtgaagggtgaacacacaggaaaagagatagttgacctcatgtgtcacgccactttcaccatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaaaaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgcactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttggtactatgcacatcacaaatcctcttgatgcggactacatgggccttgtgtgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggccaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgaggaaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgccaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 5764 - RNA, 9879 nt, synthetic construct
  misc_feature 1..9879: note = derived and/or modified CDS sequence (wt) from DENV-1__FJ547065__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgcaaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggttcaggcggattcaggatgtgtaattaattggaaaggtagagaactcaagtgtggaagtggcatttttgtcaccaatgaagttcacacttggacagagcaatacaaatttcaagctgactcccctaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgacctaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctcattcatagaagttaaaacatgtatctggccaaaatcccacactctatggagcaatggagttctggaaagtgaaatgataattccaaagatctatggaggaccaatatctcagcacaactacagaccaggatattttacacaagcagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaagaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgttcgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaatcctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaagaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgctcagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaaaatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggttcgtggagaggaaccttgtgaaaccagaagggaaagtcatagacctcggttgtggaagaggtggctggtcatactattgcgctgggctgaagaaagtcacagaagtgaaggggtatacaaaaggaggacctggacatgaggaaccaatcccaatggcgacctatggatggaacctagtaaagctgcactctgggaaagacgtattttttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacggccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5765 - RNA, 9879 nt, synthetic construct
  misc_feature 1..9879: note = derived and/or modified CDS sequence (wt) from DENV-1__FJ410230__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtaggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagacttcaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgatcggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaacacaaatactcgtggaaaagctggggaaaggctaaaatcataggggcagatgtacagaacaccaccttcatcatcgatggcccaaacaccccagagtgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggtacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcgtctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgctcagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatgtcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaggatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgactcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggataatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctaaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5766 - RNA, 9879 nt, synthetic construct
  misc_feature 1..9879: note = derived and/or modified CDS sequence (wt) from DENV-1__FJ410231__SS-prME
  source 1..9879: mol_type = other RNA
tctgtgaccatgctccttatgctgatgcctacagccttggcattccatttgactacacgaggaggagagccgcacatgatagttagcaagcaggaaagaggaaagtcacttttgttcaagacctcagcaggtgttaacatgtgcaccctcatagcgatggatttgggagagttatgtgaggacacaatgacttacaaatgtcctcgaattactgaggtggaaccagatgacgttgattgttggtgcaacaccacagacacatgggtgacctatggaacatgttcccaaactggcgagcaccgacgagacaagcgttccgtcgcactggccccacacgtgggacttggtttagaaacaagagccgaaacgtggatgtcctctgaaggcgcttggaaacagatacaaaaagtggagacttgggctctgagacacccaggattcacggtgatagccctttttctagcacatgccataggaacatccatcacccagaaagggattattttcattctgttaatgctggtgacaccttccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacattggtggaagaacaagacgcgaactttgtgtgccgacgaacgttcgtggacagaggctggggcaatggctgtgggctcttcggaaaaggaagcctgataacgtgtgctaagttcaagtgtgtgacaaaactggaaggaaagatagttcaatatgaaaatttgaaatattcagtaatagtcaccgtccacactggagaccagcaccaggtgggaaatgagagcacagaacatgggacaactgcaactataacacctcaagctcctacgtcggaaatacagctgaccgactacggagctcttacattggactgctcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtccggaacgacaacaatttttgcaggacacctgaaatgtagactaaagatggacaaactgactctaaaagggatgtcatatgtgatgtgcacaggttcattcaagctagagaaagaagtggctgagacccagcatggaaccgttttagtgcagattaaatacgaaggaacagatgcaccatgcaagatccctttttcgacccaagatgaaaaaggagtaacccagaacgggagattgataacagctaaccccatagtcactgacaaagaaaaaccagtcaacattgaggcagaaccgccttttggtgagagttacatcgtgataggagcaggcgaaaaagctttgaaactaagctggttcaagaaaggaagcagcatagggaaaatgtttgaggcaactgccagaggagcacgaaggatggccatattgggagataccgcatgggactttggttctataggaggagtgttcacgtctgttggaaaactagtacaccagatttttggaactgcatatggagttttgttcagcggtgtttcctggaccatgaagataggaataggggttctgctgacatggctaggattaaactcaaggagcacgtccctttcgatgacgtgcattgcagttggtctagtaacactatacctaggagtcatggttcaggcggattcaggatgtgtgattaattggaagggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccacccgtctcgagaatatcatgtggaggcaaatatcaaatgaactgaaccacatcttacttgaaaatgacatgaaattcacagtagttgtaggagatgttgttgggatcttggctcaaggaaaaaagatgattaggccacaacccatggaacacaaatactcgtggaaaagctggggaaaagctaaaatcataggggcagatgtacagaacaccaccttcatcatcgatggcccaaacaccccagaatgccctgatgatcaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgatatggggtactggatagaaagtgaaaagaatgagacctggaagctggcaagagcctcttttatagaagttaaaacatgtatctggccaaaatcccacaccctatggagcaatggagttctggaaagtgaaatgataattccaaaaatctatggaggaccaatatctcagcacaactacagaccaggatatttcacacaaacggcagggccgtggcacctaggcaagttggaactggattttgatttatgtgagggtaccacagttgttgtggatgaacattgtggaaatcgaggaccatctcttagaaccacaacagtcacaggaaagataattcatgaatggtgttgcagatcttgcacgctaccacccttacgtttcaaaggagaagatgggtgttggtacggtatggaaatcagaccagtcaaggaaaaggaagagaatctagtcaaatcaatggtctcagcagggtcgggggaagtggacagcttttcactaggactgttatgcatatcaataatgatcgaagaggtgatgagatccagatggagtagaaaaatgctgatgactggaacactggctgtgttcttccttctcataatgggacaattgacatggaatgatctgatcaggtcatgcatcatggttggagccaacgcttccgacaggatggggatgggaacgacgtatctagctttgatggccacttttaaaatgagaccaatgtttgctgtcgggctattattccgcagactaacatccagagaagttcttcttctaacaattggattgagtctagtggcatctgtggagttaccaaattccttggaggagctgggggatggacttgcaatgggcattatgattttaaaattattgactgattttcagtcatatcagctgtgggctaccttgctgtccttgacatttatcaaaacaacgttttccttgcactatgcatggaagacaatggctatggtactgtcaattgtatctctcctccccttatgcctgtccacgacctcccaaaaaacaacatggctcccggtgctattgggatctcttggatgcaaaccactaaccatgtttctaatagcagaaaacaaaatctggggaaggaaaagttggcccctcaatgaaggaatcatggctgttggcatagtcagcatcctactaagttcactcctcaaaaatgatgtgccgctagctgggccactaatagctggaggcatgctaatagcatgttatgttatatcaggaagctcagccgacctatcattagagaaagcggctgaggtctcttgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccagaggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcaccttcaagacccctgaaggtgaagttggagccattgccttagatttcaaacccggcacatctggatctcctatcgtgaacagagaagggaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcgggaaaaacaagaagatatcttccagccatagtccgtgaggccataaaaaggaagctgcgcacactaattttggctcccacaagggttgtcgcttccgaaatggcagaggcgctcaaggggatgccaataaggtaccaaacaacagcagtgaagagtgaacacacaggaagagagatagttgatcttatgtgtcacgccactttcaccatgcgtctcctgtctcctgtgagagttcccaattacaacatgattatcatggatgaagcacatttcaccgatccatccagcatagcggccagaggatacatctcaacccgagtgggcatgggtgaagcagctgcgatcttcatgacagccactcccccaggatcggtggaagcctttccacagagcaatgcagttatccaagatgaagaaagagacattcctgaaagatcatggaactcaggctatgagtggatcactgacttcccaggtaaaacagtttggtttgttccaagtatcaaatcaggaaatgacattgccaactgcctaagaaagaatgggaaacgggtgattcaattgagcaggaaaacctttgatacagagtaccaaaaaacaaaaaataacgactgggactacgtcgttacaacagacatctccgaaatgggagcaaacttccgggctgacagggtgatagacccaagacggtgtctgaaaccggtaatactaaaagatggtccagagcgtgtcatcttagcaggaccgatgccagtgactgtggccagtgccgcccagaggagaggaagaattggaaggaaccacaataaggaaggtgatcagtacatctacatgggacagcccttaaacaacgatgaagatcacgcccactggacagaagcaaaaatgctccttgataatataaacacaccagaagggattatcccagccctcttcgaaccggagagagaaaagagtgcagcaatagacggggaatacagactgcggggtgaagcaaggaaaacgtttgtggagctcatgagaagaggagatctacctgtctggttatcctacaaagtcgcctcagaaggcttccagtactccgacagaagatggtgctttgacggggaaaggaacaaccaggtgttggaggagaacatggacgtggagatctggacaaaagaaggagaaagaaagaaactacgaccccgctggctagatgccagaacatactcagacccactggccctgcgcgagtttaaagagtttgcagcaggaagaagaagcgtctcaggtgatttaatactagaaatagggaaacttccacaacacttgacgcaaagggcccagaatgctttggacaacctggtcatgttgcacaactccgaacaaggaggaagagcctatagacatgcaatggaagaactgccagacactatagaaacgttgatgctcctagctttgatagctgtgttgactggtggagtgacgctgttcttcctatcaggaaagggcctagggaaaacatctatcggcctactctgcgtgatggcttcaagcgcactgctatggatggccagtgtggagccccattggatagcggcctccatcatactggagttcttcttgatggtgctgcttattccagagccagacagacaacgcactccgcaagacaaccagctggcatatgtggtgataggtttgttatttatgatacttacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagccatattgatgggacttgacaaaggatggccaatatcgaagatggacataggagttccacttctagccttggggtgctattcccaagtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattctggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctacaaaaggagtgggataatggaagtggacagatccgaagccaaagagggactaagaagaggagaaacaaccaaacatgcagtgtcgagaggaaccgccaaactgaggtggtttgtggagaggaatcttgtgaaaccagaagggaaagtcatagacctcggttgtggaagaggtggctggtcatactattgcgctgggctgaagaaagtcacagaagtgaagggatacacaaaaggaggacccggacatgaggaaccaatcccaatggcgacctatggatggaacctagtaaagctgcactccgggaaagatgtattctttataccacctgagaaatgtgacacccttttgtgtgatattggtgaatcctctccaaacccaactatagaggaaggaagaacgttacgcgtcctaaagatggtggaaccatggctcagaggaaaccaattctgcataaagattctgaatccctacatgccaagtgtggtggaaaccctggaacaaatgcaaagaaaacatggaggaatgctagtgcgaaatccactttcaagaaattctacccatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaacaagacatgtggcagtggaaccagaggtagccaatctggatatcattggccagaggatagagaacataaaacatgaacacaagtcaacatggcattatgatgaggacaatccatataaaacatgggcctatcatggatcatatgaggtcaagccatcaggatcagcctcatccatggttaatggcgtggtgaaactgctcaccaaaccatgggatgtcatccctatggtcacacaaatagccatgactgacaccacaccctttggacaacagagggtgtttaaagagaaagttgacacacgcacaccaaaagcaaaacggggcactgcacaaatcatggaggtgacagccaagtggttatggggctttctttccagaaacaaaaaaccaagaatttgtacaagagaggagttcacaagaaaagttaggtcaaacgcagccattggggcagtgttcgttgatgaaaatcaatggaactcagcaaaagaagcggtggaagatgaacggttctgggaccttgtgcacagagagagggagcttcacaaacagggaaaatgcgccacgtgtgtttacaacatgatggggaagagagagaaaaagctaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaactcggatacatactcagagacatatcaaagattcctgggggaaatatgtatgcagatgacacagctggatgggatacaaggataacagaggatgaccttcagaatgaggccaaaattactgacatcatggagcctgaacatgccctactggctacgtcaatcttcaagctgacctaccaaaataaggtggtaagggtacagagaccagcaagaaatggaaccgtgatggatgtcatatccagacgtgaccagagaggaagtggccaggtcggaacttatggcttaaacactttcaccaacatggaagcccagcttataagacaaatggagtctgagggaatcttttcacccagcgagttggagaccccaaatttagccgagagagttctcgactggctggaaaaacatggcgtcgaaaggctaaaaagaatggcaatcagcggagatgactgcgtggtgaaaccaattgatgacaggtttgcaacagccttatcagctctgaatgatatgggaaaagtaagaaaagatataccacaatgggaaccctcaaaaggatggaatgattggcaacaagtgcctttttgttcacaccacttccaccagctgattatgaaggatggaagggaaatagtggtgccatgccgcaaccaagatgaacttgtgggtagggctagagtatcacaaggtgctggatggagcctgagagaaactgcatgcctaggcaagtcatatgcacaaatgtggcaactgatgtacttccacaggagagacctgagactagccgctaatgctatctgttcagccgttccagttgattgggtcccaaccagccgtaccacctggtcgatccatgcccatcaccaatggatgacaacagaagacatgttgtcagtgtggaatagggtttggatagaggaaaacccatggatggaggacaaaacccatatatccagctggggagatgttccatatttaggaaaaagggaagatcagtggtgtggatccctgataggcttaacagcaagggccacctgggccaccaacatacaagtggccataaaccaagtgagaagactaattgggaatgagaattatttagattacatgacatcaatgaagagattcaagaacgagagtgatcctgaaggggcactctggtga

SEQ ID NO: 5767 - RNA, 9879 nt, synthetic construct
  misc_feature 1..9879: note = derived and/or modified CDS sequence (wt) from DENV-1__FJ461323__SS-prME
  source 1..9879: mol_type = other RNA
tctgtgaccatgctccttatgctgatgcctacagccttggcgttccatttgaccacacgagggggagagccgcacatgatagtcagcaagcaggaaagaggaaagtcacttttgtttaagacctcagcaggtgtcaacatgtgcacccttatagcgatggacttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggtcctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgccgacgaacgtttgtggacagaggctggggcaatggctgtgggctcttcggaaaaggaagcctaataacgtgtgctaagtttaagtgtgtgacaaaactggaaggaaagatagtccaatatgaaaacttgaaatactcagtaatagtcactgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacacagcatggaaccgttctagtgcagattaaatacgaaggaacagatgcaccatgcaagatccccttttcgacccaagatgagaaaggagtaacccagaatgggagattgataacagccaaccccatagtcactgacaaagaaaaaccagtcaacattgaggcagaaccgccttttggtgagagttacatcgtgataggagcaggtgaaaaagctttgaagctaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggactaaactcaaggagcacgtccctttcgatgacgtgcattgcagtcggcctagtaacgctatacttaggagtcatggttcaggcagattcaggatgtgtaattaactggaaaggtagagaactcaaatgtggaagtggcatttttgtcaccaatgaagttcatacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaactcacagtggttgtaggagatgttgctgggatcttgggccaagggaagaaaatgattaggccacaacccatggaatataaatactcgtggaaaagctggggaaaggctaaaatcataggggcagatgcacagaacaccaccttcatcatcgacggcccaaacaccccggaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatcccacactctatggagcaatggagttttggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaatgcctccgacaggatggggatgggaacgacgtatctagctctgatggccacttttaaaatgagaccaatgtttgctgtggggctgctattccgcagactaacatccagagaagttcttcttctaacaattggattgagtctagtggcatctgtggagttaccaaattccttggaggagctgggggatggacttgcaatgggcattatgattttaaaattgttgactgactttcaatcacatcagctgtgggctaccttgctgtccttgacatttatcaaaacaacattttctttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatttggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatactagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcgaggatcctggaacacgggagaagaagtgcaggtgattgctgttgaaccagggaaaaaccccaaaaatgtacaaacggcgccgggcacctttaagacccctgaaggcgaagttggagccattgctctagattttaaacccggcacatctggatctcccatcgtgaacagagaaggaaaaatagtgggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacattttacagatccatccagcatagcggccagagggtacatctcaacccgagtgggcatgggtgaagcggctgcgatcttcatgacagccactcccccaggatcagtggaggcctttccacagagcaacgcagttatccaagatgaggaaagagacattcctgagagatcatggaactcaggctatgagtggatcaccgacttcccaggcaaaacagtttggtttgttccaagcattaaatcaggaaatgacattgccaactgcttaagaaagaatgggaagcgggtgattcaattgagcaggaaaacctttgacacagagtaccaaaaaacaaaaaataacgactgggactacgttgtcacaacagacatctccgaaatgggagcgaatttccgggccgacagggtgatagacccaagacggtgtctgaaaccggtaatactaaaggatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcagtagacggggaatacagactgcgaggtgaagcaaggaaaacgtttgtggagctcatgagaagaggagatctacctgtctggctatcctacaaagttgcttcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaataggaaaacttccacaacacttgacgcaaagggcccagaatgccttggacaacctggttatgctgcacaattccgaacaaggaggaagagcctatagacatgcaatggaagaactgccagacaccatagaaacgttaatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacagcaaacatttccctgacagccattgcaaaccaggcagctatattgatgggacttgacaaaggatggccaatatcgaagatggacataggggttccacttctcgctttggggtgctattcccaggtgaatccactgacgctgacagcggcggtattgatgctagtggcccattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatttagcaggagcaggtctggccttctcattaatgaaatctctaggaggaggtaggagaggcacaggagcccaaggggaaacactgggagagaaatggaaaagacagctgaaccaactgagcaagtcagaattcaacacctataaaaggagtgggattatggaagtggacagatctgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaggtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcctctccaaacccaactatagaggaaggaagaacgctacgcgtcctaaagatggtggaaccatggctcagaggaaaccaattctgcataaaaattctgaatccctacatgccaagtgtggtggaaactctggagcaaatgcaaagaaaacatggaggaatgctagtgcgaaatccactttcaagaaattctacccatgaaatgtattgggtttcatgtggaacaggaaacattgtgtcagcagtaaacatgacatctagaatgttgctaaatcgattcacaatggctcacaggaaaccaacatatgaaagagacgtggacctaggcaccggaacaagacatgtggcagtggaaccagaggtagccaacctagatattattggccagaggatagagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttgggcaacagagggtgtttaaagagaaagttgacacacgcacaccaaaagcaaaacgaggtacagcacaaatcatggaggtgacagccaggtggttatggggttttctttctagaaacaagaaaccaagaatttgtacaagagaggagttcacaagaaaagttaggtcaaacgcagccatcggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagtttggaaaggcaaaaggaagtcgtgcaatatggtacatgtggttgggagcacgttttctagagttcgaagctcttggtttcatgaacgaagaccactggttcagtagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgttatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagctctcgattggctggaaaaatatggcgtcgaaaggctaaaaagaatggcaatcagtggagatgattgcgtagtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacaggagagacctaagactagccgctaatgctatctgttcagccgttccagttgattgggtcccaactagccgcaccacctggtcgatccatgcccatcaccaatggatgacaacagaagacatgctgtcagtgtggaatagggtttggatagaggaaaacccatggatggaggacaaaacccatatatccagctgggaagatgttccatatttagggaaaagggaagatcaatggtgtggatccctgataggcttaacagcaagggccacctgggccaccaacatacaagtggctataaaccaagtgagaagactaattgggaatgagaattatctagattacatgacatcaatgaagagattcaagaacgagactgatcccgaaggggcactctggtga

SEQ ID NO: 5768 - RNA, 9879 nt, synthetic construct
  misc_feature 1..9879: note = derived and/or modified CDS sequence (wt) from DENV-1__FJ461325__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgcaaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggttcaggcggattcaggatgtgtaattaattggaaaggtagagaactcaagtgtggaagtggcatttttgtcaccaatgaagttcacacttggacagagcaatacaaatttcaagctgactcccctaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctcattcatagaagttaaaacatgtatctggccaaaatcccacactctatggagcaatggagttctggaaagtgaaatgataattccaaagatctatggaggaccaatatctcagcacaactacagaccaggatattttacacaagcagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaagaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgttcgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttataacagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaatcctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgctcagaggagaggaagaattggaaggaatcacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaataaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggttcgtggagaggaaccttgtgaaaccagaagggaaagtcatagacctcggttgtggaagaggtggctggtcatactattgcgctgggctgaagaaagtcacagaagtgaaggggtatacaaaaggaggacctggacatgaggaaccaatcccaatggcgacctatggatggaacctagtaaagctgcactctgggaaagacgtattttttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggttaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaagccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcggccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5769 - RNA, 9879 nt, synthetic construct
  misc_feature 1..9879: note = derived and/or modified CDS sequence (wt) from DENV-1__FJ410232__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgttcaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgacagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagtttaagtgtgtgacaaaactggaaggaaaaatagtccaatatgaaaacttgaaatactcagtaatagtcaccgtccacactggagaccagcaccaggtgggaaatgaaagcacagaacatgggacaactgcaactataacacctcaagctcctacaacggaaatacagctgactgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccccttttcgacccaagatgagaaaggagtaacccagaatgggagattgataacagccaaccccatagtcactgacaaagaaaaaccagtcaacattgaggcagaaccgccttttggtgagagttacatcgtgataggagcaggtgaaaaagctttgaagctaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagtcggcctagtaacgctatacttaggagtcatggttcaggcggattcaggatgtgtaattaactggaaaggtagagaactcaaatgtggaagtggcatttttgttaccaatgaagttcatacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaactcacagtggttgtaggagatgttgctgggatcttgggccaagggaaaaaaatgattaggccacaacccatggaatataaatactcgtggaaaagctggggaaaggctaaaatcataggggcagatgcacagaacaccaccttcatcatcgacggcccaaacaccccggaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgatatggggtactggatagaaagtgaaaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatattttacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcctccgacaggatggggatgggaacgacgtatctagctctgatggccacttttaaaatgagaccaatgtttgctgtggggctgctattccgcagactaacatccagagaagttcttcttctaacaattggattgagtctagtggcatctgtggagttaccaaattccttggaggagctgggggatggacttgcaatgggcattatgattttaaaattgttgactgactttcaatcacatcagctgtgggctaccttgctgtccttgacatttatcaaaacaacattttctttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatttggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgtttcacacaatgtggcatgtcaccaggggagctgtactcatgtatcaagggaagagactggaaccgagctgggccagtgtcaaaaaagacctgatctcatatggaggaggttggaggcttcgaggatcctggaacacgggagaagaagtgcaggtgattgctgttgaaccaggaaaaaaccccaaaaatgtacaaacggcgccgggcacctttaagacccctgaaggcgaagttggagccattgctctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcttgtctcccgtgagagttcccaattacaacatgattatcatggatgaagcacattttacagatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcaccgacttcccaggcaaaacagtttggtttgttccaagcattaaatcaggaaatgacattgccaactgcctaagaaagaatgggaagcgggtgattcaattgagcaggaaaacctttgacacagagtaccaaaaaacaaaaaataacgactgggactacgtcgtcacaacagacatctccgaaatgggagcgaatttccgggccgacagggtgatagacccaagacggtgtctgaaaccggtaatactaaaggatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcagtagacggggaatacagactgcgaggtgaagcaaggaaaacgtttgtggagctcatgagaagaggagatctacctgtctggctatcctacaaagttgcttcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggttatgctgcacaattccgaacaaggaggaagagcctatagacatgcaatggaagaactgccagacaccatagaaacgttaatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacagcaaacatttccctgacagccattgcaaaccaggcagctatattgatgggacttgacaaaggatggccaatatcgaagatggacataggggttccacttctcgctttggggtgctattcccaggtgaatccactgacgctgacagcggcggtattgatgctagtggcccattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatttagcaggagcaggtctggccttctcattaatgaaatctctaggaggaggtaggagaggcacgggagcccaaggggaaacactgggagaaaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaggtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcctctccaaacccaactatagaggaaggaagaacgctacgcgtcctaaagatggtggagccatggctcagaggaaaccaattctgcataaaaattctgaatccctacatgccaagtgtggtggaaactctggagcaaatgcaaagaaaacatggaggaatgctggtgcgaaatccactttcaagaaattctacccatgaaatgtattgggtttcatgtggaacaggaaacattgtgtcagcagtaaacatgacatccagaatgttgctaaatcgattcacaatggctcacaggaaaccaacatatgaaagagacgtggatctaggcaccggaacaagacatgtggcagtggaaccagaggtagccaacctagatattattggccagaggatagagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttgggcaacagagggtgtttaaagagaaagttgacacacgtacaccaaaagcaaaacgaggcacagcacaaatcatggaggtgacagccaggtggttatggggttttctttctagaaacaagaaaccaagaatttgtacaagagaggagttcacaagaaaagttaggtcaaacgcagccataggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagtttggaaaggcaaaaggaagtcgtgcaatatggtacatgtggttgggagcacgttttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgttatatccagacgtgaccagagaggaagtggccaggtcggaacttatggcttaaacactttcaccaacatggaagcccagctgataagacaaatggagtctgagggaatcttttcacccagtgaattagagactccaaatttagccgagagagctctcgattggctggaaaaatatggcgtcgaaaggctaaaaagaatggcaatcagtggagatgattgcgtagtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacaggagagacctaagactagccgctaatgctatctgttcagccgttccagttgattgggtcccaactagccgcaccacctggtcgatccatgctcatcaccaatggatgacaacagaagacatgctgtcagtgtggaatagggtttggatagaggaaaacccatggatggaggacaaaacccatatatccagctgggaagatgttccatatttagggaaaagggaagaccaatggtgtggatccctgataggcttaacagcaagggccacctgggccaccaacatacaagtggctataaaccaagtgagaagactaattgggaatgagaattatctagattacatgacatcaatgaagagattcaagaacgagagtgatcctgaaggggcactctggtga

SEQ ID NO: 5770 - RNA, 9879 nt, synthetic construct
  misc_feature 1..9879: note = derived and/or modified CDS sequence (wt) from DENV-1__FJ461327__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgcaaagttcaagtgtgtgacaaaactggaaggaaagatagttcaatatgagaacttgaaatattcagtaatagtcaccgttcacaccggagaccagcatcaagtgggaaatgaaagcacagaacatgggacaactgcaactataacacctcaagctcctacgacggaaatacagctgaccgactacggagctcttacattggattgttcacctagaacaggactggactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggttcaggcggattcaggatgtgtaattaattggaaaggtagagaactcaagtgtggaagtggcatttttgtcaccaatgaagttcacacttggacagagcaatacaaatttcaagctgactcccctaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctcattcatagaagttaaaacatgtatctggccaaaatcccacactctatggagcaatggagttctggaaagtgaaatgataattccaaagatctatggaggaccaatatctcagcacaactacagaccaggatattttacacaagcagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaagaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgttcgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattcttcttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcaccttcaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaatcctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgctcagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaatatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccctggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctatcggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacatgggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactgggcctctgaccacgctttgggagggatcgccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggttcgtggagaggaaccttgtgaaaccagaagggaaagtcatagacctcggttgtggaagaggtggctggtcatactattgcgctgggctgaagaaagtcacagaagtgaaggggtatacaaaaggaggacctggacatgaggaaccaatcccaatggcgacctatggatggaacctagtaaagctgcactctgggaaagacgtattttttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagacgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5771 - RNA, 9879 nt, synthetic construct
  misc_feature 1..9879: note = derived and/or modified CDS sequence (wt) from DENV-1__FJ461328__SS-prME
  source 1..9879: mol_type = other RNA
tctgtgaccatgctccttatgctgatgcctacagccctggcgttccatttgactacacgagggggagagccgcacatgatagtcagcaagcaggaaagaggaaagtcacttttgtttaagacctcagcaggtgtcaatatgtgcacccttatagcgatggatttgggagagttatgtgaggacacaatgacttacaaatgccctcgaatcactgaggcggaaccggatgacgttgattgttggtgcaatgccacagacacatgggtgacctatggaacatgttcccaaactggcgagcaccgacgagaaaaacgttccgtcgcactggccccacacgtgggacttggtttggaaacaagaactgaaacgtggatgtcctctgaaggcgcttggaaacagatacaaagggtggagacttgggccctgagacacccaggattcacggtgatagccctttttctagcacatgccataggaacatctatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacattggtggaagaacaagacgcgaactttgtgtgtcgacgaacgtttgtggacagaggctggggcaatggctgtgggctcttcggaaaaggaagcctactaacgtgtgctaagttcaagtgtgtgacaaaactggaaggaaagatagttcaatatgaaaacttgaaatattcagtaatagtcaccgtccacactggagaccagcatcaggtgggaaatgaaagcacagaacatgggacaactgcaactataacacctcaagctcccacgacggaaatacagctgaccgactacggagctcttacattggattgttcacctagaacaggactagactttaatgaaatggtgttgttgacaatgaaagaaaaatcatggctagtccacaaacaatggtttctagacttaccactgccttggacttcgggagcttcgacatcacaagagacttggaatagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagactcagcatggaaccgttctagtgcagattaaatatgaaggaacagatgcaccatgcaagattcctttttcgacccaagatgaaaaaggagtaacccagaatgggagattgataacagccaaccccatagtcactgacaaggaaaaaccagtcaacattgaggcagaaccgccttttggtgagagttacatcgtgataggagcaggtgaaaaagctttgaaactaagctggttcaagaaaggaagtagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctctcgatgacgtgcattgcagttggcctagtaacactatacctaggagtcatggttcaggcggattcaggatgcgtaattaattggaaaggtagagaactcaaatgtggaagtggtatttttgtcaccaatgaagttcacacttggacagagcaatacaaatttcaagctgactccccaaagagactatcagcagccattgggaaggcatgggaggagggtgtgtgtggaattcgatcagcaactcgtctcgagaacatcatgtggaagcaaatatcaaatgaactgaaccacatcttacttgaaaatgacatgaaattcacagtggttgtaggagatgttgctgggatcttggttcaaggaaaaaaaatgattaggccacaacccatggaatacaaatactcgtggaaaagctggggaaaggctaaaatcataggggcagatgtacagaactccaccttcatcattgacggcccaaacaccccagaatgccctgatgaccaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgacatgggctactggatagaaagtgaaaagaacgagacctggaagctggcaagagcctctttcatagaagttaaaacatgcatttggccaaaatcccacactctatggagcaatggagttctggaaagtgaaatgataattccaaagatccatggaggaccaatatctcagcacaactacagaccaggatatttcacacaaacggcagggccgtggcacctaggcaagttggaactggattttgatttgtgtgagggtaccacagtcgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacagttgacatggaatgatctgatcagattatgcatcatggttggagccaacgcttccgacagaatggggatgggaacgacgtacctagctctgatggccacttttaaaatgagaccaatgtttgctgtagggctattattccgcagactaacatccagagaagttcttcttctaacaattggattgagtctagtggcatctgtggagttaccaaattccttggaggagctgggggatggacttgcaatgggcatcatgattttaaaattattgactgactttcaatcatatcagttgtgggctaccttgctgtccttgacatttatcaaaacaacgttttccctgcactatgcatggaagacaatggctatggtactgtcaattgtatctctcttccccttatgcctgtccacgacctcccagaaaacaacatggcttccggtgctattgggatctcttggatgcaaaccactaaccatgtttctaatagcagaaaacaaaatttggggaaggaaaagttggcccctcaatgaagggatcatggctgttggaatagtcagcatcctattaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactcaggtgcctcacacaacatattagtggaggtccaagatgatggaaccatgaagataaaggatgaagagagagatgacacactaaccattctccttaaagcaactctgctagcagtttcaggggtgtacccattatcaataccagcgaccctttttgtgtggcacttttggcagaaaaagaaacagagatctggagtgttgtgggacacacctagccctccagaagtggaaagagcagttcttgatgatggtatctatagaattatgcagagaggactgttgggcaggtcccaagtaggggtgggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggtttcaaggatcctggaacacgggagaagaagtgcaggtgattgctgttgaaccagggaaaaaccccaaaaatgtacaaacagcgccgggcacctttaagacccctgaaggtgaagttggagccattgccctagatttcaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaagtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgagatggcagaagcgctcaagggaatgccaataaggtaccaaacaacagcagtgaagagtgaacacacaggaaaagagatagttgacctcatgtgtcacgctactttcaccatgcgcctcctgtctcccgtgagagttcccaattacaatatgattatcatggatgaagcacatttcaccgatccatccagcatagcggccagagggtacatctcaacccgagtgggcatgggtgaagcagctgcaatcttcatgacagccactcccccaggatcaatggaggcctttccacagagtaacgcagttatccaagatgaggaaagagacattcctgagagatcatggaactcaggctatgagtggatcactgacttcccaggtaaaacagtctggtttgttccaagcattaaagcaggaaatgacattgccaactgcttaagaaagaatggaaaacgagtgattcaattgagcaggaaaacctttgatacagagtatcaaaaaacaaaaaataacgactgggactacgtcgtcacaacagacatctccgaaatgggagcaaatttccgggccgacagggtgatagacccaagacggtgtctgaaaccggtaatattaaaagatggtccagagcgtgtcattttggcaggaccgatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctctttgagccggagagagaaaagagtgcagcaatagacggggaatatagactgcggggtgaagcaaggaaaacgtttgtggagctcatgagaagaggagacctacctgtctggctgtcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatactagaaatagggaaacttccacaacacttgacgcaaagggcccagaatgccttggacaacttggtcatgttgcacaactccgaacaaggaggaagagcctatagacatgcaatggaagaactgccagacaccatagaaacattgatgctccttgctttgatagctgtgttaactggtggagtgacgctgttcttcctatcaggaaagggcctagggaaaacatctatcggcctactctgcgtgatggcttcaagcgtactactatggatggccagtgtggagccccattggatagcggcctccatcatactggagttcttcctaatggtgttgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagccatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccattgatggaattgttgcaatagatttggaccctgtggtttatgatgcaaaatttgagaaacaactaggccaaataatgttgttgatactatgcacatcacagatcctcttgatgcggactacatgggccctgtgtgaatccatcacactggccactggacctctgaccacgctttgggagggatctccaggaaaattttggaacaccacgatagcggtttccatggcaaacatttttagaggaagttatctagcaggagcaggtttggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaactgaggtggttcgtggagaggaaccttgtgaaaccagaagggaaagtcatagaccttggttgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattcttcataccacctgagaaatgtgatacccttttgtgtgatattggtgagtcctctccaaacccaactatagaggaaggaagaacgctacgcgttctaaagatggtggaaccatggctcagaggaaaccaattttgcataaagattctgaatccctatatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaagtgacagccaggtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgaccggttctgggaccttgtgcacagagagagggagcttcacaaacagggaaaatgtgccacgtgtgtttacaacatgatggggaagagagaaaaaaaactaggagagttcggaaaggcaaaaggaagtcgtgcaatatggtacatgtggttgggagcacgctttctagagtttgaagctcttggtttcatgaacgaagatcactggttcagcagagagaattcactcagcggagtggaaggggaaggacttcacaaacttggatatatactcagagacatatcaaagattccagggggaaacatgtatgcagatgacacagccggatgggatacaaggataacagaggatgacctccagaatgaggccaaaattactgacatcatggaacccgaacatgccctactggctaagtcaatcttcaagctaacctaccaaaataaggtggtaagggtacagagaccagcaaaaaatggaaccgtgatggatgtcatatccagacgtgaccagagaggaagtggccaggttggaacctatggcttaaacactttcaccaacatggaagcccagctgataagacaaatggagtctgagggaatctttttacccaacgaattagagaccccaaatttagccgggagagttctcgactggctggaaaaatatggcgtcgaaaggctgaaaagaatggcaatcagcggagatgactgcgtagtgaaaccaattgatgataggttcgcgacagccttaacagctctgaatgatatgggaaaagtaagaaaagacataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgactgggtcccaaccagccgcaccacctggtcgatccatgcccatcaccaatggatgacaacagaagacatgctgtcagtgtggaatagggtttggatagaggaaaacccatggatggaggacaaaacccgtatatccagttgggaagatgttccatatctaggaaaaagggaagatcaatggtgtggatctctgataggcttaacagcaagggccacctgggccaccaacatacaagtggccataaaccaagtgagaagactaattgggaatgagaattattcagattacatgacatcaatgaagagattcaagaacgagagtgaacccgaaggggcactctggtga

SEQ ID NO: 5772 - RNA, 9879 nt, synthetic construct
  misc_feature 1..9879: note = derived and/or modified CDS sequence (wt) from DENV-1__FJ410234__SS-prME
  source 1..9879: mol_type = other RNA
tctgtgaccatgctccttatgctgatgcctacagccttggcgttccatttgaccacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcactcagaaagggattatcttcattttgttaatgctggttacaccatccatggccatgcgatgcgtgggaataggcagcagggacttcgtggaaggactgtcaggagcaacttgggtagatgtggtactggaacatggaagttgtgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagtttaagtgtgtgacaaaactggaaggaaagatagtccaatatgaaaacttgaaatactcagtaatagtcaccgtccacactggagaccagcaccaggtgggaaatgaaagcacagaacatgggacaactgcaactataacacctcaagctcccacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaggtggctgagacccagcatggaaccgttctagtgcagatcaaatacgaaggaacagatgcaccatgcaagatccccttttcgacccaagatgagaaaggagtaacccagaatgggagattaataacagccaaccccatagtcactgacaaagaaaaaccagtcaacattgaggcagaaccgccttttggtgagagttacatcgtgataggagcaggtgaaaaagctttgaagctaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcatagcagtcggcctagtaacgctatacttaggagtcatggttcaggcggattcaggatgtgtaattaactggaaaggtagagaactcaaatgtggaagtggcatttttgttaccaatgaagttcatacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaactcacagtggttgtaggagatgttgctgggatcttgggccaagggaaaaaaatgattaggccacaacccatggaatataaatactcgtggaaaagctggggaaaggctaaaatcataggggcagatgcacagaacaccaccttcatcatcgacggcccaaacaccccggaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgagaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgtacgctaccacccttacgtttcagaggagaagatgggtgctggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcctccgacaggatggggatgggaacgacgtatctagctctgatggccacttttaaaatgagaccaatgtttgctgtggggctgctattccgcagactaacatccagagaagttcttcttctaacaattggattgagtctagtggcatctgtggagttaccaagttccttggaggagctgggggatggacttgcaatgggcattatgattttaaaattgttgactgactttcaatcacatcagctgtgggctaccttgctgtccttgacatttatcaaaacagcattttctttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatttggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatactagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggcatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcgaggatcctggaacacgggagaagaagtgcaggtgattgctgttgaaccagggaaaaaccccaaaaatgtacaaacggcgccgggcacctttaagacccctgaaggcgaagttggagccattgctctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcgggaaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacattttacagatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcaccgacttcccaggcaaaacagtttggtttgttccaagcattaaatcaggaaatgacattgccaactgcttaagaaagaatgggaagcgggtgattcaattgagcaggaaaacctttgacacagagtaccaaaaaacaaaaaataacgactgggactacgtcgtcacaacagacatctctgaaatgggagcgaatttccgggccgacagggtgatagacccaagacggtgtctgaaaccggtaatactaaaggatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcagtagacggggaatacagactgcgaggtgaagcaaggaaaacgtttgtggagctcatgagaagaggagatctacctgtctggctatcctacaaagttgcttcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaataggaaaacttccacaacacttgacgcaaagggcccagaatgccttggacaacctggttatgctgcacaattctgaacaaggaggaagagcctatagacatgcaatggaagaactgccagacaccatagaaacgttaatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacagcaaacatttccctgacagccattgcaaaccaggcagctatattgatgggacttgacaaaggatggccaatatcgaagatggacataggggttccacttctcgctttggggtgctattcccaggtgaatccactgacgctgacagcggcggtattgatgctagtggcccattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccactgggcctctgaccacgctttgggagggatctccaggaaaattttggaacaccacgatagcggtttccatggcaaacattttcagaggaagttatttagcaggagcaggtctggccttctcattaatgaaatctctaggaggaggtaggagaggcacaggagcccaaggggaaacactgggagagaaatggaaaagacagctgaaccaactgagcaagtcagaattcaacacctataaaaggagtgggattatggaagtggacagatctgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaggtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcctctccaaacccaactatagaggaaggaagaacgctacgcgtcctaaagatggtggagccatggctcagaggaaaccaattctgcataaaaattctgaatccctacatgccaagtgtggtggaaactctggagcaaatgcaaagaaaacatggaggaatgctagtgcgaaatccactttcaagaaattctacccatgaaatgtattgggtttcatgtggaacaggaaacattgtgtcagcagtaaacatgacatccagaatgttgctaaatcgattcacaatggctcacaggaaaccaacatatgaaagagacgtggacctaggcaccggaacaagacatgtggcagtggaaccagaggtagccaacctagatattattggccagaggatagagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttgggcaacagagggtgtttaaagagaaagttgacacacgcacaccaaaagcaaaacgaggtacagcacaaatcatggaggtgacagccaggtggttatggggttttctttctagaaacaagaaaccaagaatttgtacaagagaggagttcacaagaaaagttaggtcaaacgcagccatcggagcagtgtttgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagtttggaaaggcaaaaggaagtcgtgcaatatggtacatgtggttgggagcacgttttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgttatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagctctcgattggctggaaaaatatggcgtcgaaaggctaaaaagaatggcaatcagtggagatgattgcgtagtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacaggagagacctaagactagccgccaatgctatctgttcagccgttccagttgattgggtcccaactagccgcaccacctggtcgatccatgcccatcaccaatggatgacaacagaagacatgctgtcagtgtggaatagggtttggatagaagaaaacccatggatggaggacaaaacccatatatccagctgggaagatgttccatatttaggaaaaagggaagatcaatggtgtggatccctgataggcttaacagcaagggccacctgggccaccaacatacaagtggctataaaccaagtgagaagactaattgggaatgagaattatctagattatatgacatcaatgaagagattcaagaacgagagtgatcccgaaggggcactctggtga

SEQ ID NO: 5773 - RNA, 9879 nt, synthetic construct
  misc_feature 1..9879: note = derived and/or modified CDS sequence (wt) from DENV-1__FJ410235__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagacttcaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacaactaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgatagttccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctactttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtgaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcaattatccaagatgaggaaagagacattcctgagagatcatggaactcaggctatgagtggatcactgacttcccgggtaaaacagtttggtttgttccaagcatcaaatcaggaaatgacattgccaactgcttaagaaagaatggaaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcggacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccactcctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggcattctcattaatgaaatctctaggaggaggtaggagaggcacgggagcccaaggggaaacactgggagagaaatggaaaagacagctgaaccaactgggcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggatgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaacccctacatgccaagtgtggtggaaactctggagcaaatgcaaagaaaacatggaggaatgctggtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagacgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctagaaaaacatggcgtcgaaaggctgaaaagaatggcaatcagcggagatgactgcgtagtgaaaccaattgatgataggtttgcaacagccttaacagctctgaatgacatgggaaaagttagaaaagatataccacaatgggaaccttcaaaaggatggaatgattggcaacaagtgcctttttgctcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaactcacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagatttaagaacgagagtgatcctgaaggggcactctggtga

SEQ ID NO: 5774 - RNA, 9879 nt, synthetic construct
  misc_feature 1..9879: note = derived and/or modified CDS sequence (wt) from DENV-1__FJ410236__SS-prME
  source 1..9879: mol_type = other RNA
tctgtgaccatgctccttatgctggtgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacccagaacaggactagactttaatgaaatggtgttgttgacaatgaaagaaaaatcatggctagtccacaaacaatggtttttggacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctatgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagctctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcctctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggcgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtaacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccttgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaagtctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcaaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5775 - RNA, 9879 nt, synthetic construct
  misc_feature 1..9879: note = derived and/or modified CDS sequence (wt) from DENV-1__FJ410238__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttataagtgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaaggaccgaaacgtggatgtcctctgaaggcgcttggaaacagatacaaagagtggaaacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaagccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacacaggagaccagcaccaggtgggaaatgaaagcacagaacatgggacaactgcaactataacacctcaagctccttcaacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaatagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttccataggaggagtgttcacgtctgtcggaaaattagtacaccagatctttggaactgcatatggagtcttgttcagcggtgtttcctggaccatgaaaataggaataggagttctgctgacatggctaggtttaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggaaggtgtgtgtggaatacgatcagcaactcgtctcgagaacatcatgtggaagcaaatatcaaatgaactgaaccacatcttacttgaaaatgacatgaaactcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaagacagcaaggcagttcacgctgatatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggatagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacacttccgacaggatggggatgggaacgacgtacctagctctgatggccacttttaaaatgagaccaatgtttgctgtaggactattattccgcagactaacatccagagaagttcttcttttaacaattggattgagtctagtggcatctgcggagttaccaaattccttggaggagctgggggatggacttgcaatgggcattatgattttgaaattattgactgactttcaatcacatcagttgtgggctaccttgctgtccttgacatttatcagaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcaaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgttctcatgtatcaagggaagaggctggaaccgagctgggccagtgtcaaaaaagacctgatctcatatggaggaggttggaggcttcaaggatcctggaacacgggagaagaagtgcaggtgattgctgttgaaccaggaaaaaacccaaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttgacaataatggacctacatccaggatcggggaaaacaagaagatatcttccagccatagtccgtgaggccataaaaaggaggctgcgcacattaattttggctcccacaagggttgtcgcttccgaaatggcagaggcgctcaagggaatgccaataaggtaccaaacaacagcagtgaagagtgaacacacaggaaaagagatagttgatctcatgtgtcacgccactttcactatgcgcctcctgtctcccgtgagagttcccaattacaacatgattatcatggatgaagcgcatttcaccgatccatccagcatagcggccagagggtacatctcaacccgagtgggcatgggtgaggcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcaattgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgacaatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagagcccagaatgccttggacaatctggttatgttgcacaactccgaacaaggaggaagagtctatagacatgcaatggaagaactgccagacaccatagaaacgttgatgctcctagctttgatagctgtgttaactggtggagtgacgctattcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagctaatgagatgggactgctggaaaccacaaagaaagacttagggatcggccatgtggctgttgaaaatcaccatcatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtattgatgctagtggctcactacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacgctgggagagaaatggaaaagacagctgaaccaactgagtaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattcttcataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattttgaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatccagaatgttgctaaaccgattcacaatggctcacaggaaaccaacatatgaaagagacgtggacctaggcgccggaacaagacatgtggcagtggaaccagaggtagccaacctagacatcattggccagaggatagagaacataaaacatgaacataagtcaacatggcattatgatgaggacaacccatataaaacatgggcctaccatggatcatatgaggttaagccgtcaggatcagcctcatccatggtcaatggcgtggtgaaactgctcaccaaaccatgggatgtcatccccatggtcacacaaatagccatgactgacaccacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgctacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatgtatccagttggggagatgttccatatttaggaaaaagggaagatcaatggtgtggatccctgataggcttaacagcaagggccacctgggccaccaacatacaagtggccataaaccaagtgagaagactacttgggaatgagaattatctagattacatgacatcaatgaagaggttcaagaatgagagtgatcctgaaggggcactctggtga

SEQ ID NO: 5776 - RNA, 9879 nt, synthetic construct
  misc_feature 1..9879: note = derived and/or modified CDS sequence (wt) from DENV-1__FJ410239__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacgtacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagttacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtgacccagaatgggagattgataacagctaaccccatagttactgacaaagaaaaaccagttaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgctggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatataaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaatacaaatactcgtggaaaagttggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgtttttgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaatcatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcttggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcactatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcgaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagctatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactactgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacaccacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaacttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5777 - RNA, 9879 nt, synthetic construct
  misc_feature 1..9879: note = derived and/or modified CDS sequence (wt) from DENV-1__FJ410240__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggataattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaacccagccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgcccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccataaacaatggtttctagacctaccactgccttggacttcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggtcgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtgctgtcaattgtatctctcttccccttatgcctgtccacgacttcccaaaaaacaacatggcttccggtgttattgggatctcttggatgcaaaccactaaccatgtttcttatagcagaaaacaaaatctggggaaggaaaagttggcccctcaatgaaggaatcatggctgttggaatagtcagcatcctactaagttcacttctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcgcacaacatattagtggaggtccaagatgatggaaccatgaagataaaggatgaagagagagatgacacgctaaccattctccttaaagcaaccctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggtaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggctggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccactcctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggcattctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagacatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagagtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgacatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaactcacatatccagttggggagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 5778 - RNA, 9879 nt, synthetic construct
  misc_feature 1..9879: note = derived and/or modified CDS sequence (wt) from DENV-1__FJ410242__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgttggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacattcaagacagctcatgcaaagaagcaggaagtagtcgtactaggatcacaagaaggagcaatgcacactgcgttgaccggagcaacagaaatccaaacgtctggaacgacaacaatttttgcaggacatttgaaatgcagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggcgtgtgtggaatacgatcaacaactcgtctcgagaacatcatgtggaagcaaatatcaaatgaactgaaccacatcttacttgaaaatgacatgaaattcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgctctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgttggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagctcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacaaagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtgaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgttagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgtctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataacataaacacaccagaagggattatcccagccctcttcgagccggagagagaaaagagtgcagcaatagacggggaatatagactacggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgctgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttacaaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagaccttggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaatccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcgattctgggaccttgtgcacagagagagggagcttcacaaacaggggaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggcttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaactcacatatccagttggggagatgttccatatttaggaaaaagggaagatcaatggtgtggatccctgataggcttgacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5779 - RNA, 9879 nt, synthetic construct
  misc_feature 1..9879: note = derived and/or modified CDS sequence (wt) from DENV-1__FJ410243__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttaggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagcaaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaagcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaagagggatgtcatatgtaatgtgcacaggctcattcaagctagagaaagaagtggctgagacccagcatggaaccgttctagtgcagattaaatatgaaggaacagatgcaccatgcaagatacctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacatcagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcatggaaaagctggggaaaggctaaaatcataggggcagatgtgcagaatgccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcattatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggacccatgaagataaaggatgaagagagagatgacatgctaaccattctcctgaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgccttctgtctcccgtgagagttcccaattacaacatgattatcatggatgaagcacatttcaccgatccatccagcatagcggccagagggtacatctcaacccgagtgggtatgggtgaagcagctgctatcttcatgacagctactcccccaggatcaatggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaataacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaaggagaagcgtctcaggtgatctaatattagaaatagggaaacttccacaacacttgacgcaaagggcccagaatgccttggacaatctggttatcttgcacaactccgaacaaggaggaagagcctatagacatgcaatggaggaactgccagacaccatagaaacgttgatgctcctagctttgatagctgtgttaactggtggagtgacgctgttcttcctatcagggaggggcctagggaaaacatctatcggcctactctgtgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatacaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtctccatggcaaacatttttagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgtgtcctaaagatggtggaaccatggctcagaggaaaccaattttgcataaaaattctgaatccctacatgccaagtgtggtggaaactttggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctagaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgcaggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagattgatcctgaaggggcactctggtga

SEQ ID NO: 5780 - RNA, 9879 nt, synthetic construct
  misc_feature 1..9879: note = derived and/or modified CDS sequence (wt) from DENV-1__FJ410244__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccattgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatgaacaagctgactctaaaagggatgtcatatgtaatgtgcacaggctcattcaagctagagaaagaagtggctgagacccagcatggaaccgttttagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaggctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacctatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaatttgcgtgattcctacacccaagtgtgtgaccaccggctaatgtcagctgccatcaaggacagcaaggcagttcacgctgacatggggtactggatagaaagtgaaaagaacgagacctggaagctggcaagagcctcttttatagaagttaaaacatgtatctggccaaagtcccatactctatggagcaatggagttctggaaagtgaaatgataattccaaagatctatggaggaccaatatctcagcacaactacagaccaggatatttcacacaaacggcagggccgtggcacctaggcaagttggaactggactttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacgattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattattatggatgaagcacatttcaccgatccatccagcatagcggccagagggtacatctcaacccgagtgggcatgggggaagcagctgcgatcttcatgacagctactcccccaggatcagtggaggcctttccacagagcaacgcaattatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccttgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggaaccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtgcccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggtttagcagagagaattcactcagcggagtggaaggagaaggactccacaaacttggatatatactcagggacatatcaaagattccagggggaaacatgtatgcagatgacacagccggatgggatacgaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaatactttcaccaacatggaagctcagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatgtaccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcaatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 5781 - RNA, 9879 nt, synthetic construct
  misc_feature 1..9879: note = derived and/or modified CDS sequence (wt) from DENV-1__FJ410245__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttgtgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgcaaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagttgaccgactacggagctcttacattggattgttcacccagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgactggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggttcaggcggattcaggatgtgtaattaattggaaaggtagagaactcaagtgtggaagtggcatttttgtcaccaatgaagttcacacttggacagagcaatacaaatttcaagctgactcccctaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctcattcatagaagttaaaacatgtatctggccaaaatcccacactctatggagcaatggagttctggaaagtgaaatgataattccaaagatctatggaggaccaatatctcagcacaactacagaccaggatattttacacaagcagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcaaaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaagaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgttcgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacataggagaagaagtgcaggtgattgctgttgaaccagggaaaaaccccaaaaatgtacaaacagcgccgggcacctttaagacccctgaaggcgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaagaagctgcgcacactaatcctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgctgctcagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggttcgtggagaggaaccttgtgaaaccagaagggaaagtcatagacctcggttgtggaagaggtggctggtcatactattgcgctgggctgaagaaagtcacagaagtgaaggggtatacaaaaggaggacctggacatgaggaaccaatcccaatggcaacctatggatggaacctagtaaagctgcactctgggaaagacgtattttttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatctagaatgttgctaaatcgattcacaatggctcacaggaaaccaacatatgagagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcataaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5782 - RNA, 9879 nt, synthetic construct
  misc_feature 1..9879: note = derived and/or modified CDS sequence (wt) from DENV-1__FJ410246__SS-prME
  source 1..9879: mol_type = other RNA
tctgtgaccatgctcctcatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacttaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggataagctgactctaaaggggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagacaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgtttacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagctatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgaccgaagaggtgatgagatccagatggagtagaaaaatgctgatgactggaacactggctgtgttcttccttctcataatgggacaactgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtgcttcttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacaacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgttagctgggccactaatagctggaggcatgctaatagcatgttatgttatatccggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaggacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccatgaggccataaaaaggaagctgcgcacattaattctggctcccacaagggttgtcgcttccgaaatggcagaggcgctcaagggaatgccaataaggtaccaaacgacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagtaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacgtctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatttggttatgttgcacaactccgaacaaggaggaagagcctatagacacgcaatggaggaattgccagacaccatagaaacgttgatgctcctagctttgatagctgtgttaactggtggagtgacgctgttcttcctatcaggaagaggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgtcgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcagcggtattgatgctagtggctcattacgccataattggacctggactgcaagcaaaagctactagagaagctcaaaaaaggacagcagccggcataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaatattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacatgcagtgtcgagaggaacagctaaactgagatggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtacgaaatccactttcaagaaattctactcatgaaatgtattgggtttcatgtggaacaggaaacattgtgtcagcagtaaatatgacatccagaatgttgctaaatcgattcacaatggctcacaggaaaccaacgtacgaaagagacgtggacctaggcgccggaacaagacatgtggcagtggaacctgaggtagctaacctagatatcattggccagaggatagagaacataaaacatgaacataagtcaacatggcattatgatgaggacaatccatacaaaacatgggcctaccatggatcatatgaggtcaagccatcaggatcagcctcatccatggttaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaagacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaagatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatacttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 5783 - RNA, 9879 nt, synthetic construct
  misc_feature 1..9879: note = derived and/or modified CDS sequence (wt) from DENV-1__FJ410247__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaaatcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagacaaaccaacattggacattgaactcttgaagacggaagtcacaaaccctgccatcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgttcacaccggagaccagcaccaggtgggaaatgaaagcacagaacatgggacaactgcaactataacacctcaagctcctacgacggaaatacagctgactgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagcccatgcaaagaagcaagaagtggtcgtactaggatcacaagaaggagcaatgcacactgcgttgaccggagcaacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaattataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctatacccaagtgtgtgaccaccggctaatgtcagctgccatcaaggacagcaaggcagttcacgctgacatggggtactggatagaaagtgaaaagaacgagacctggaagctggcaagagcttctttcatagaagttaaaacatgtatctggccaaaatcccacactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcctccttctcataatgggacaattgacatggaatgatctgatcagattatgcatcatggttggagccaacgcttccgacaggatggggatgggaacgacgtacctagctctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctattgggatcccttggatgcaaaccactaaccatgtttctcatagcagaaaacagaatctggggaaggagaagttggcccctcaatgaaggaatcatggctgttggaatagtcagcatcctactaagttcacttctcaaaaatgatgtgccgctagctgggccactaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatttcatatggaggaggttggaggcttcaaggatcctggaacacaggagaagaagtgcaggtgattgctgttgaaccagggaaaaaccccaaaaatgtacaaacaacgccgggcacttttaagacccctgaaggtgaagttggagccattgccctagattttaaacccggcacatctggatctcccatcgtgaacagagaaggaaaaatagtgggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtaatccaagatgaggaaagagacattcctgagagatcatggaactcaggctatgagtggatcactgacttcccaggtaaaacagtttggtttgttccaagcattaaatcaggaaatgacatagccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaggcaaggaaaacgtttgtggagctcatgagaagaggagatctacctgtctggctatcttacaaagttgcctcagaaggcttccagtactctgacagaagatggtgctttgacggggaaaggaacaaccaggtgttggaggagaacatggacgtggagatctggacaaaagagggagaaagaaagaaactacgaccccgctggctggatgccagaacatactcagacccactagccctgcgcgagtttaaagagtttgcagcagggagaagaagcgtctcaggtgatctaatattggaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagtttttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttggggattggccatgtggctgttggaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgagatggtttgtggagcggaaccttgtgaaaccagaagggaaagtcatagacctcggttgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagatgtggacctaggcgccggaacaagacatgtggcagtggaaccagaggtagctaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacaaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataactgaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgattgcgtggtgaaaccaattgatgataggtttgcaacagccttaacagctctgaatgacatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattggatcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttagggaaaagggaagatcaatggtgtggatccctgataggcttaacagcaagggccacctgggccaccaacatacaagtggccataaaccaagtgagaagactaattgggaatgagaattacctagattacatgacatcaatgaagagattcaagaacgagagtgatcccgaaggggcactctggtga

SEQ ID NO: 5784 - RNA, 9879 nt, synthetic construct
  misc_feature 1..9879: note = derived and/or modified CDS sequence (wt) from DENV-1__FJ410248__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagctttgtgaggacacaatgacttacaagtgccctcgaatcactgaggcggaaccagatgacgttgattgttggtgcaatgccacagacacatgggtgacctatggaacatgttcccaaactggcgagcaccgacgagacaaacgttccgtcgcactagccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattatcttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaacttttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtgatagtcaccgtccacactggagaccagcaccaggtgggaaatgaaagcacagaacacgggacaactgcaactataacacctcaagctccttcgacggaaatacagctgaccgactacggagctcttacattggattgttcacctagaacaggactagacttcaatgaaatggtgttgttgacaatgaaagaaaaatcatggctagtccacaaacaatggtttctagacctaccactgccttggacctcgggagcttcaacatcacaagagacttggaacagacaagatttgcttgtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgtggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacatgcattgcagttggcctagtaacattatacctaggagtcatggttcaggcggattcaggatgtgtaattaattggaaaggcagagaactcaaatgtggaagtggcatttttgtcaccaatgaagttcacacttggacagagcaatacaaatttcaagctgactccccaaagagactatcagctgccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggtcgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctagcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttaatttgtgtgagggtaccacagttgttgtggatgaacactgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgctagctgtaggactattattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgtattccttgcactatgcatggaagacaatggccatggtactgtcaattgtatctctcttccccttatgcctgtccacgacctcccaaaaaacaacatggcttccggtgctattgggatctcttggatgcaaaccactaaccatgtttctcatagcagaaaacaaaatctggggaaggaaaagttggcccctcaatgaaggaatcatggctgttggaatagtcagcattctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggctccaaggatcctggaacacgggagaagaagtgcaggtgattgccgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcccctaccagagattgaaaacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcagttgagcagaaaaacttttgatacagagtaccaaaaaacaaaaaataacgactgggactacgtcgtcacaacagacatctctgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggctcagaatgccttggacaatctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcttagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatattgacagtagcagccaatgagatgggactgctggaaaccacaaagaaagacttagggattggccatgtggctgttgaaaatcaccaccatgccgcaatgctggatgtagacttacatccagcttcagcctggaccctctatgcagtggccacaacaattatcactcccatgatgaggcacacaatcgaaaacacaacggcaaacatttccctgacagccattgcaaaccaggcggccatattaatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacactacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccagctgagcaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacttagtaaaactgcactccgggaaagacgtattcttcataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaatattgtgtcagcagtaaacatgacatccagaatgttgctaaatcgattcacaatggctcacaggaaaccaacgtatgaaaaagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacaaatcatggaggtgacagccaagtggttatggggttttctctctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggggagtttggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcgatctttaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtgtcacaaggtgctggatggagcctgagagaaactgcatgcctaggcaagtcatatgcacaaatgtggcagttgatgtacttccacaggagagacctgagactagccgctaatgctatctgttcagccgttccagttgactgggtcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaggtggccataaaccaagtgagaagactgattgggaatgagaattatctagattacatgacatcaatgaagagattcaagaacgagagtgatcctgaaggggcactctggtga

SEQ ID NO: 5785 - RNA, 9879 nt, synthetic construct
  misc_feature 1..9879: note = derived and/or modified CDS sequence (wt) from DENV-1__FJ410249__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggcacatgttcccaaactggcgagcgccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggagtaggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttttagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggagctgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggactcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaacccgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacctatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctcttttatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggactttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttctttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaactggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctctcggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagccggaggcatgctaatagcatgttatgttatatctggaagctcagccgacctatcactagagaaagcagctgaggtctcctgggaagaagaagcagaacactctggtgcctcacacaacatactagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgagatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattattatggatgaagcacatttcaccgatccatccagcatagcggccagagggtacatctcaacccgagtgggcatgggtgaagcagctgcgatcttcatgacagctacccctccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttgagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcaatacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagctgcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgtcgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggccatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaatcccaatggcgacctatggatggaacctagtaaaactgcactccgggaaagacgtattctttataccacccgagaaatgtgacacccttttgtgtgacattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagggacatatcaaagattccagggggaaacatgtatgcagatgacacagccggatgggacacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaatactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatgtaccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgccaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 5786 - RNA, 9879 nt, synthetic construct
  misc_feature 1..9879: note = derived and/or modified CDS sequence (wt) from DENV-1__FJ410251__SS-prME
  source 1..9879: mol_type = other RNA
tctgtgaccatgcttctcatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggatcattttcattttgttaatgctggtaacaccatccatggccatgcgatgcgtaggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgccgacgaacgtttgtggatagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccacaaacaatggtttctagacctaccactgccttggacctcaggagcttcaacatcacaagagacttggaacagacaagatttgctggtgacattcaagacagctcatgcaaagaagcaggaagtagtcgtgctaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagactgataacagctaatcctatagtcactgacaaagaaaaaccagtcaacattgaggcagaaccgccctttggtgagagttacatcgtaataggagcaggtggaaaagctttgaaactaagctggttcaagaaaggaagtagcatagggaaaatgtttgaggcaactgccagaggagcacgaagaatggccatactgggggacaccgcatgggactttggttctgtaggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggaagagagctcaaatgtggaagtggcatctttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaataccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgctatcaaggacagcaaggcagttcatgctgacatggggtactggatagaaagtgaaaagaacgagacctggaagctggcaagagcctccttcatagaagttaaaacatgcatttggccaaaatcccacactctatggagcaatggagttctggaaagtgaaatgataattccaaagatctatggaggaccaatatctcagcacaactacagaccaggatatttcacacaaacagcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacctttacgttttaaaggagaggatgggtgttggtacggcatggaaatcagaccagttaaggaaaaggaagagaatctagtcaaatcaatggtctctgcagggtcaggggaagtggacagcttctcactaggactgctatgcatatcaataatgatcgaagaggtgatgagatccagatggagtagaaaaatgttgatgactggaacactggctgttttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactgacatccagagaagttctccttcttacaattggattgagtctagtggcatctgtggagttaccaaattccttggaggagctgggagatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttataacagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatactagtggaggtccaagatgatggaactatgaagataaaggatgaagagagagatgacacgctaaccattctccttaaagcaactctgctagcagtttcaggggtgtacccattatcaataccagcgaccctttttgtgtggtacttctggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagatctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagtcggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcctccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgtgagtttaaagagtttgcagcaggaagaagaagcgtctcaggtgatctaatattagaaatagggaagcttccacaacacttgacgcaaagggcccagaatgccttagacaacctggtcatgttgcacaactccgaacaaggaggaagagcctatagacatgcaatggaagaattgccagacaccatagaaacgctgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacaggcaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttgggatgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgtagatggaattgttgcaatagacttggaccctgtggtctatgatgcaaaatttgagaaacaactaggccaaataatgttgttaatattatgcacctcacagatcctcttgatgaggaccacatgggccttgtgcgaatccatcacactggccactggacctctgaccacgctttgggagggatctccagggaaattttggaacactacgatagcggtttccatggcaaacattttcagaggaagttatctagcaggagcaggtctggccttctcactaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggttggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacactcttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggctgtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagagagcttcacaaacagggaaaatgtgccacgtgtgtttacaacatgatggggaagagagagaaaaaactaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgctcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 5787 - RNA, 9879 nt, synthetic construct
  misc_feature 1..9879: note = derived and/or modified CDS sequence (wt) from DENV-1__FJ410252__SS-prME
  source 1..9879: mol_type = other RNA
tctgtgaccatgctcctcatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagctctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctacgtaaactgtgcattgaagctaaaatatcaaacaccaccactgactcaagatgtccaacacaaggagaagccacactggtggaagaacaagacgcgaactttgtgtgtcgacgaacgcttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacctgaaatgtagattaaagatggataagctgactctaaaggggatgtcatatgtaatgtgcacaggctcattcaagctagagaaagaagtggctgagacccagcatggaaccgttctagtgcagattaaatatgaaggaacagatgcaccatgcaagatcccttttttgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcgggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgactaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtactacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggccgtgttcttccttctcataatgggacaactgacatggaatgatctgatcagattatgcatcatggttggagccaacgcttccgacaggatggggatgggaacgacgtacctagctctgatggccacttttaaaatgagaccgatgtttgctgtaggactattattccgcagactaacatccagagaagtacttcttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacaacctcccaaaaaacaacatggcttccggtgctattgggatctcttggatgcaaaccgctaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaggacctgatctcatatggaggaggttggagacttcaaggatcctggaacacgggagaagaagtgcaggtgattgctgttgaaccaggaaaaaaccccaaaaatgtacaaacagcgccgggcacctttaagacctctgaaggtgaagttggagccattgccctagatttcaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagctactcccccaggatcagtggaggcttttccacagagtaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaacttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggcgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaattgccagacaccatagaaacgttgatgctcctagctttgatagctgtgttaactggtggagtgacgctgttctttctatcaggaagaggcctagggaaaacatctatcggcctactctgcgtgatggcttcaagcgtgctgctatggatggccagtgtggagccccattggatagcggcctccatcatattggagttcttcctgatggtgctgcttattccagagccagacagacaacgcactccgcaggacaaccagctggcatacgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggcaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtgttctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattttgaatccctacatgccaagtgtggtggaaactctggagcaaatgcaaagaaaacatgggggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagctaacctagatatcattggccagaggatagagaacataaaacatgaacataagtcaacatggcattatgatgaggacaatccatacaaaacatgggcctaccatggatcatatgaggtcaagccatcaggatcagcctcatccatggttaatggcgtggtgaaactgctcaccaaaccatgggatgtcatccccatggtcacacaaatagccatgactgacactacaccctttggacaacagagggtgttcaaagagaaagttgacacacgcacaccaaaagcaaagcgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttctcccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagctgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatacttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 5788 - RNA, 9879 nt, synthetic construct
  misc_feature 1..9879: note = derived and/or modified CDS sequence (wt) from DENV-1__FJ461331__SS-prME
  source 1..9879: mol_type = other RNA
tctgtgaccatgctccttatgctgatgcctacagccttggcgttccatttgaccacacgagggggagagccgcacatgatagtcagcaagcaggaaagaggaaagtcacttttgtttaagacctcagcaggtgtcaacatgtgcacccttatagcgatggacttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattattttcattttgttaatgctggttacaccatccatggccatgcgatgcgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccactaccgactcaagatgtccaacacaaggagaagccacactggtggaagaacaagacgcgaactttgtatgtcgacgaacgtttgtggacagaggctggggcaatggctgtgggctcttcggaaaaggaagcctaataacgtgtgctaagtttaagtgtgtgacaaaactggaaggaaagatagtccaatatgaaaacttgaaatactcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaggtggctgagacccagcatggaaccgttctagtgcagattaaatacgaaggaacagatgcaccatgcaagatccccttttcgacccaagatgagaaaggagtaacccagaatgggagattgataacagccaaccccatagtcactgacaaagaaaaaccagtcaacattgaggcagaaccgccttttggtgagagttacatcgtgataggagcaggtgaaaaagctttgaagctaagctggttcaagaaaggaagcagcatagggaaaatgtttgaggcaactgccagaggagcacgaaggatggccatactgggagacaccgcatgggactttggttctataggaggagtgttcacgtctgttggaaaattaatacaccagatttttggaactgcatatggagttttgttcagcggtgtttcctggaccatgaaaataggaataggggttttgctgacatggctaggattaaactcaaggagcacgtccctttcgatgacgtgcattgcagtcggcctagtaacgctatacttaggagtcatggttcaggcggattcaggatgtgtaattaactggaaaggtagagaactcaaatgtggaagtggcatttttgttaccaatgaagttcatacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaactcacagtggttgtaggagatgttgctgggatcttgggccaaggaaaaaaaatgattaggccacaacccatggaatataaatactcgtggaaaagctggggaaaggctaaaatcataggggcagatgcacagaacaccaccttcatcatcgacggcccaaacaccccggagtgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgagaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgccttcgacaggatggggatgggaacgacgtatctagctctgatggccacttttaaaatgagaccaatgtttgctgtggggctgctattccgcagactaacatccagagaagttcttcttctaacaattggattgagtctagtggcatctgtggagttaccaaattccttggaggagctgggggatggacttgcaatgggcattatgattttaaaattgttgactgactttcaatcacatcagctgtgggctaccttgctgtccttgacatttatcaaaacaacattttctttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatttggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaatatactagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagtagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcgaggatcctggaacacgggagaagaagtgcaggtgattgctgttgaaccagggaaaaaccccaaaaatgtacaaacggcgccgggcacctttaagacccctgaaggcgaagttggagccattgctctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgtctcctgtctcccgtgagagttcccaattacaacatgattatcatggatgaagcacattttacagatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggccatgagtggatcaccgacttcccaggcaaaacagtttggtttgttccaagcattaaatcaggaaatgacattgccaactgcttaagaaagaatgggaagcgggtgattcaattgagcaggaaaacctttgacacagagtaccaaaaaacaaaaaacaacgactgggactacgtcgtcacaacagacatctccgaaatgggagcgaatttccgggccgacagggtgatagacccaagacggtgtctgaaaccggtaatactaaaggatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagcgcagcagtagacggggaatacagactgcgaggtgaagcaaggaaaacgtttgtggagctcatgagaagaggagatctacctgtctggctatcctacaaagttgcttcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaataggaaaacttccacaacacttgacgcaaagggcccagaatgccttggacaacctggttatgctgcacaattccgaacaaggaggaagagcctatagacatgcaatggaagaactgccagacaccatagaaacgttaatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagtttttcctgatggtgctgcttattccagagccagatagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacagcaaacatttccctgacagccattgcaaaccaggcagctatattgatgggacttgacaaaggatggccaatatcgaagatggacataggggttccacttctcgctttggggtgctactcccaggtgaatccactgacgctgacagcggcggtattgatgctagtggcccattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacactttgggagggatctccaggaaaattttggaacaccacgatagcggtttccatggcaaacattttcagaggaagttatttagcaggagcaggtctggccttctcattaatgaaatccctaggaggaggtaggagaggcacaggagcccaaggggaaacactgggagagaaatggaaaagacagctgaaccaactgagcaagtcagaattcaacacctataaaaggagtgggattatggaagtggacagatctgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaggtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcctctccaaacccaactatagaggaaggaagaacgctacgcgtcctaaagatggtggagccatggctcagaggaaaccaattctgcataaaaattctgaatccctacatgccaagtgtggtggaaactctggagcaaatgcaaagaaaacatggaggaatgctagtgcgaaatccactttcaagaaattctacccatgaaatgtattgggtttcatgtggaacaggaaacattgtgtcagcagtaaacatgacatccagaatgttgctaaatcgattcacaatggctcacaggaaaccaacatatgaaagagacgtggacctaggcaccggaacaagacatgtggcagtggaaccagaggtagccaacctagatattattggccagaggatagagaacataaaacatgaacacaagtcaacatggcattatgatgaggacaatccatacaaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttgggcaacagagggtgtttaaagagaaagttgacacacgcacaccaaaagcaaaacgaggtacagcacaaatcatggaggtgacagccaggtggttatggggttttctttctagaaacaagaaaccaagaatttgtacaagagaggagttcacaagaaaagttaggtcaaacgcagccatcggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagtttggaaaggcaaaaggaagtcgtgcaatatggtacatgtggttgggagcacgttttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacacgccctactggctaaggcaatcttcaagctaacctaccaaaataaagtggtaagggtacagagaccagcaaaaaatggaaccgtgatggatgttatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagctctcgattggctggaaaaatatggcgtcgaaaggctaaaaagaatggcaatcagtggagatgattgcgtagtgaaaccaattgatgataggtttgcaacagccttaacagctctgaatgatatgggaaaagtaagaaaagatataccacaatgggaaccttcaaaaggatggaatgattggcagcaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacagaagagacctaagactagccgctaatgctatctgttcagccgttccagttgattgggtcccaactagccgcaccacctggtcgatccatgcccatcaccaatggatgacaacagaagacatgctgtcagtgtggaatagggtttggatagaggaaaacccatggatggaggacaaaacccatatatccagctgggaagatgttccatatttagggaaaagggaagatcaatggtgtggatccctgataggcttaacagcaagggccacctgggccaccaacatacaagtggctataaaccaagtgagaagactaattgggaatgagaattatctagattacatgacatcaatgaagagattcaagaacgagagtgatcccgaaggggcactctggtga

SEQ ID NO: 5789 - RNA, 9879 nt, synthetic construct
  misc_feature 1..9879: note = derived and/or modified CDS sequence (wt) from DENV-1__FJ410256__SS-prME
  source 1..9879: mol_type = other RNA
tctgtgaccatgctcctcatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaaaagtggagacttgggccctgagacacccaggattcacggtgatagcccttttcctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacacgaactttgtgtgtcgacgaacgtttgtggacagaggctggggcaatggatgtgggctcttcggaaaaggaagcctaataacgtgtgctaagttcaagtgtgttacaaaactggaaggaaagatagttcaatatgaaaacttgaaatattcagtaatagtcaccgtccacactggagaccagcaccaggtgggaaatgaaagcacagaacatgggacaactgcaactataacaccgcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacattcaagacagctcatgcaaagaagcaggaagtagtcgtactaggatcacaagaaggagcaatgcacactgcgttgaccggagcaacagaaatccaaacgtctggaacgacaacaatttttgcaggacatttgaaatgcagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggcgtgtgtggaatacgatcaacaactcgtctcgagaacatcatgtggaagcaaatatcaaatgaactgaaccacatcttacttgaaaatgacatgaaattcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggattatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatctagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagctcactcctcaaaaatgatgtgccgctagctgggccactaatagctggaggcatgctaatagcatgttatgttatatctggaagctcagccgacctatcactagagaaagcagctgaggtctcttgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacaaagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtgaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgttagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgtctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactacggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtggtggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgctgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctactcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttacaaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagaccttggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaatccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcgattctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggcttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgccgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgctcagccgttccagttgattgggtcccaaccagccgcaccacctggtcgatccatgcccatcaccaatggatgacaacagaagacatgctgtcagtgtggaatagggtttggatagaggaaaacccatggatggaggacaaaactcacatatccagttggggagatgttccatatttaggaaaaagggaagatcaatggtgtggatccctgataggcttgacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5790 - RNA, 9879 nt, synthetic construct
  misc_feature 1..9879: note = derived and/or modified CDS sequence (wt) from DENV-1__FJ410257__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgttcaagacctcagcaggtgtcaacatgtgcacccttatagcgatggatttgggagagttatgtgaggacacaatgacttacaaatgccctcgaatcactgaggcggaaccagatgacgttgattgctggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttttagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagtttaagtgtgtgacaaaactggaaggaaaaatagtccaatatgaaaacttgaaatactcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgttctaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatcccctttacgacccaagatgagaaaggagtaacccagaatgggagattgataacagccaaccccatagtcactgacaaagaaaaaccagtcaacattgaggcagaaccgccttttggtgagagttacatcgtgataggagcaggtgaaaaagctttgaagctaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagtcggcctagtaacgctatacttaggagtcatggttcaggcggattcaggatgcgtaattaactggaaaggtagagaactcaaatgtggaagtggcatttttgtcaccaatgaagttcatacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaactcacagtggttgtaggagatgttgctgggatcttgggccaaggaaaaaaaatgattaggccacaacccatggaatataaatactcgtggaaaagctggggaaaggctaaaatcataggggcagatgcacagaacaccactttcatcatcgacggcccaaacaccccggaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcctccgacaggatggggatgggaacgacgtatctagctctgatggccacttttaaaatgagaccaatgtttgctgtggggctgctattccgcagactaacatccagagaagttcttcttctaacaattggattgagtctagtggcatctgtggagttaccaaattccttggaggagctgggggatggacttgcaatgggcattatgattttaaaattgttgactgactttcaatcacatcagctgtgggctaccttgctgtccttgacatttatcaaaacaacattttctttgcactatgcatggaagacaatggctatggtactgtcaattgtatctctcttccccttatgcctgtccacgacctcccaaaaaacaacatggcttccggtgctattgggatctcttggatgcaaaccattaaccatgtttcttatagcagaaaacaaaatttggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaggagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatatatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggctagtgtcaaaaaagacctgatctcatatggaggaggatggaggcttcgaggatcctggaacacgggagaagaagtgcaggtgattgctgttgaaccagggaaaaaccccaaaaatgtacaaacggcgccgggcacctttaagacccctgaaggcgaagttggagccattgctctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacattttacagatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcaccgacttctcaggcaaaacagtttggtttgttccaagcattaaatcaggaaatgacattgccaactgcctaagaaagaatgggaagcgggtgattcaattgagcaggaaaacctttgacacagagtaccaaaaaacaaaaaataacgactgggactacgtcgtcacaacagacatctccgaaatgggagcgaatttccgggccgacagggtgatagacccaagacggtgtctgaaaccggtaatactaaaggatggtccagagcgtgtcattttagcaggaccgatgccagtgactgtggccagtgccgcccagaggagaggaagaattggaaggaactacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcagtagacggggaatacagactgcgaggtgaagcaaggaaaacgtttgtggagctcatgagaagaggagatctacctgtctggctatcctacaaagttgcttcagaaggcttccagtactctgacagaagatggtgctttgacggggaaaggaacaaccaggtgttggaggagaacatggacgtggagatctggacaaaagaaggagacagaaagaaactacgaccccgctggctggatgccagaacatactcagacccactggccctgcgcgagttaaaagagtttgcagcaggaagaagaagcgtctcaggtgatctaatattagaaatagggaaacttccacaacacttgacgcaaagggcccagaatgccttggacaacctggttatgctgcacaattccgaacaaggaggaagagcctatagacatgcaatggaagaactgccagacaccatagaaacgttaatgctcctagctctgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagaaccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacagcaaacatttccctgacagccattgcaaaccaggcagctatattgatgggacttgacaaaggatggccaatatcgaagatggacataggggttccacttctcgctttggggtgctattcccaggtgaatccactgacgctgacagcggcggtattgatgctagtggcccattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatttagcaggagcaggtctggccttctcattaatgaaatctctaggaggaggtaggagaggcacgggagcccaaggggaaacactgggagaaaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaggtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcctctccaaacccaactatagaggaaggaagaacgctacgcgtcctaaagatggtggagccatggctcagaggaaaccaattctgcataaaaattctgaatccctacatgccaagtgtggtggaaactctggagcaaatgcaaagaaaacatggaggaatgctagtgcgaaatccactttcaagaaattctacccatgaaatgtattgggtttcatgtggaacaggaaacattgtgtcagcagtaaacatgacatccagaatgttgctaaatcgattcacaatggctcacaggaaaccaacatatgaaagagacgtggacctaggcaccggaacaagacatgtggcagtggaaccagaggtagccaacctagatattattggccagaggatagagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttgggcaacagagggtgtttaaagagaaagttgacacacgcacaccaaaagcaaaacgaggcacagcacaaatcatggaggtgacagccaggtggttatggggttttctttctagaaacaagaaaccaagaatttgtacaagagaggagttcacaagaaaagttaggtcaaacgcagccatcggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagtttggaaaggcaaaaggaagtcgtgcaatatggtacatgtggttgggagcacgttttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgttatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagctctcgattggctggaaaaatatggcgtcgaaaggctaaaaagaatggcaatcagtggagatgattgcgtagtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacaggagagacctaagactagccgctaatgctatctgttcagccgttccagttgattgggtcccaactagccgcaccacctggtcgatccatgcccatcaccaatggatgacaacagaagacatgctgtcagtgtggaatagggtttggatagaggaaaacccatggatggaggacaaaacccatatatccagctgggaagatgttccatatttagggaaaagggaagaccaatggtgtggatccctgataggcttaacagcaagggccacctgggccaccaacatacaagtggctataaaccaagtgagaagactaattgggaatgagaattatctagattacatgacatcaatgaagagattcaagaacgagagtgatcctgaaggggcactctggtga

SEQ ID NO: 5791 - RNA, 9879 nt, synthetic construct
  misc_feature 1..9879: note = derived and/or modified CDS sequence (wt) from DENV-1__FJ461332__SS-prME
  source 1..9879: mol_type = other RNA
tctgtgaccatgctccttatgctgatgcctacagccttggcgttccatttgaccacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattattttcattttgttaatgctggttacaccatccatggccatgcgatgcgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccactaccgactcaagatgtccaacacaaggagaagccacactggtggaagaacaagacgcgaactttgtatgccgacgaacgtttgtggacagaggctggggcaatggctgtgggctcttcggaaaaggaagtctaataacgtgtgctaagtttaagtgtgtgacaaaactggaaggaaagatagtccaatatgaaaacttgaaatactcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaggtggctgagacccagcatggaaccgttctagtgcagattaaatacgaaggaacagatgcaccatgcaagatccccttttcgacccaagatgagaaaggagtaacccagaatgggagattgataacagccaaccccatagtcactgacaaagaaaaaccagtcaacattgaggcagaaccgccttttggtgagagttacatcgtgataggagcaggtgaaaaagctttgaagctaagctggttcaagaaaggaagcagcatagggaaaatgtttgaggcaactgccagaggagcacgaaggatggccatactgggagacaccgcatgggactttggttctataggaggagtgttcacgtctgttggaaaattaatacaccagatttttggaactgcatatggagttttgttcagcggtgtttcctggaccatgaaaataggaataggggttctgctgacatggctaggattaaactcaaggagcacgtccctttcgatgacgtgcattgcagtcggcctagtaacgctatacttaggagtcatggttcaggcggattcaggatgtgtaattaactggaaaggtagagaactcaaatgtggaagtggcatttttgttaccaatgaagttcatacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaactcacagtggttgtaggagatgttgctgggatcttgggccaaggaaaaaaaatgattaggccacaacccatggaatataaatactcgtggaaaagctggggaaaggctaaaatcataggggcagatgcacagaacaccaccttcatcatcgacggcccaaacaccccggaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgagaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgacctgatcagattatgcatcatggttggagccaacgccttcgacaggatggggatgggaacgacgtatctagctctgatggccacttttaaaatgagaccaatgtttgctgtggggctgctattccgcagactaacatccagagaagttcttcttctaacaattggattgagtctagtggcatctgtggagttaccaaattccttggaggagctgggggatggacttgcaatgggcattatgattttaaaattgttgactgactttcaatcacatcagctgtgggctaccttgctgtccttgacatttatcaaaacaacattttctttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatttggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaatatactagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagtagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcgaggatcctggaacacgggagaagaagtgcaggtgattgctgttgaaccagggaaaaaccccaaaaatgtacaaacggcgccgggcacctttaagacccctgaaggcgaagttggagccattgctctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgtctcctgtctcccgtgagagttcccaattacaacatgattatcatggatgaagcacattttacagatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggccatgagtggatcaccgacttcccaggcaaaacagtttggtttgttccaagcattaaatcaggaaatgacattgccaactgcttaagaaagaatgggaagcgggtgattcaattgagcaggaaaacctttgacacagagtaccaaaaaacaaaaaataacgactgggactacgtcgtcacaacagacatctccgaaatgggagcgaatttccgggccgacagggtgatagacccaagacggtgtctgaaaccggtaatactaaaggatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaaggaattatcccagccctcttcgagccggagagagaaaagagtgcagcagtagacggggaatacagactgcgaggtgaagcaaggaaaacgtttgtggagctcatgagaagaggagatctacctgtctggctatcctacaaagttgcttcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaataggaaaacttccacaacacttgacgcaaagggcccagaatgccttggacaacctggttatgctgcacaattccgaacaaggaggaagagcctatagacatgcaatggaagaactgccagacaccatagaaacgttaatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttttttctgatggtgctgcttattccagagccagatagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacagcaaacatttccctgacagccattgcaaaccaggcagctatattgatgggacttgacaaaggatggccaatatcgaagatggacataggggttccacttctcgctttggggtgctactcccaggtgaatccactgacgctgacagcggcggtattgatgctagtggcccattacgccataattggacctggactgcaagcaaaagctactagagaagctcaaaaaaggacagcggccggaataatgaaaaatccaaccgttgatggaatcgttgcaatagatttggaccctgtggtttatgatgtaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatttagcaggagcaggtctggccttctcattaatgaaatccctaggaggaggtaggagaggcacaggagcccaaggggaaacactgggagagaaatggaaaagacagctgaaccaactgagcaagtcagaattcaacacctataaaaggagtgggattatggaagtggacagatctgaagccaaagagggactgaaaagaggagaaacaaccaaacatgcagtgtcgagaggaaccgctaaattgaggtggtttgtggagaggaaccttgtgaaaccagaagggaaagtcatagacctcggctgtggaagaggtggctggtcatactattgcgctgggctgaagaaggtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcctctccaaacccaactatagaggaaggaagaacgctacgcgtcctaaagatggtggagccatggctcagaggaaaccaattctgcataaaaattctgaatccctacatgccaagtgtggtggaaactctggagcaaatgcaaagaaaacatggaggaatgctagtgcgaaatccactttcaagaaattctacccatgaaatgtattgggtttcatgtggaacaggaaacattgtgtcagcagtaaacatgacatccagaatgttgctaaatcgattcacaatggctcacaggaaaccaacatatgaaagagacgtggacctaggcaccggaacaagacatgtggcagtggaaccagaggtagccaacctagatattattggccagaggatagagaacataaaacatgaacacaagtcaacatggcattatgatgaggacaatccatacaaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttgggcaacagagggtgtttaaagagaaagttgacacacgcacaccaaaagcaaaacgaggtacagcacaaatcatggaggtgacagccaggtggttatggggttttctttctagaaacaagaaaccaagaatttgtacaagagaggagttcacaagaaaagttaggtcaaacgcagccatcggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagtttggaaaggcaaaaggaagtcgtgcaatatggtacatgtggttgggagcacgttttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacacgccctactggctaaggcaatcttcaagctaacctaccaaaataaagtggtaagggtacagagaccagcaaaaaatggaaccgtgatggatgttatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagctctcgattggctggaaaaatatggcgtcgaaaggctaaaaagaatggcaatcagtggagatgattgcgtagtgaaaccaattgatgataggtttgcaacagccttaacagctctgaatgatatgggaaaagtaagaaaagatataccacaatgggaaccttcaaaaggatggaatgattggcagcaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacagaagagacctaagactagccgctaatgctatctgttcagccgttccagttgattgggtcccaactagccgcaccacctggtcgatccatgcccatcaccaatggatgacaacagaagacatgctgtcagtgtggaatagggtttggatagaggaaaacccatggatggaggacaaaacccatatatccagctgggaagatgttccatatttagggaaaagggaagatcaatggtgtggatccctgataggcttaacagcaagggccacctgggccaccaacatacaagtggctataaaccaagtgagaagactaattgggaatgagaattatctagattacatgacatcaatgaagagattcaagaacgagagtgatcccgaaggggcactctggtga

SEQ ID NO: 5792 - RNA, 9879 nt, synthetic construct
  misc_feature 1..9879: note = derived and/or modified CDS sequence (wt) from DENV-1__FJ461333__SS-prME
  source 1..9879: mol_type = other RNA
tctgtgaccatgctccttatgctgatgcctacagccttggcgttccatttgaccacacgagggggagagccgcacatggtagtcagcaagcaggaaagaggaaaatcactcttgttcaagacctcagcaggtgtcaacatgtgtacccttatagcgatggatctgggagagttatgtgaggacacaatgacttacaaatgccctcgaatcactgaagctgaaccagatgacgttgactgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagacaaaccaacattggacattgaactcttgaagacggaagtcacaaaccctgccatcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgttcacaccggagaccagcatcaggtgggaaatgaaagcacagaacatgggacaactgcaactataacacctcaagctcctacgacggaaatacagctgactgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacctggaacagacaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggattaggggttctgctgacatggctaggattaaactcaaggagcacgtccctttcgatgacgtgcattgcagttggcctagtaacactatacttaggagtcatggttcaggcggattcaggatgtgtaattaattggaaaggtagagaactcaaatgtggaagtggcatttttgtcaccaatgaagtccacacctggacagagcaatacaaatttcaagctgactccccaaagagactatcagcagccatcgggaaggcatgggaggagggtgtgtgtggaattcgatcagcaactcgtctcgagaacgtcatgtggaagcaaatatcaaatgaactgaatcacatcttacttgaaaatgatatgaaattcacagtggttgtaggagatgttgctgggatcttggctcaaggaaagaaaatgattaggccacaacccatggaacacaaatactcgtggaaaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcctccttctcataatgggacaattgacatggaatgatctgatcagattatgcatcatggttggagccaacgcttccgacaggatggggatgggaacgacgtacctagctctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcgattgtatctctcttccccttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcacttctcaaaaatgatgtgccgctagctgggccactaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggccactaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccaccttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtaatccaagatgaggaaagagacattcctgagagatcatggaactcaggctatgagtggatcactgacttcccaggtaaaacagtttggtttgttccaagtattaaatcaggaaatgacatagccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagagggagaaagaaagaaactacgaccccgctggctggatgccagaacatactcagacccactagccctgcgcgagtttaaagagtttgcagcagggagaagaagcgtctcaggtgatctaatattagaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcttatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttagggattggccatgcggctgttggaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaagagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtattctttataccacctgagaaatgtgatacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagatgtggacctaggcgccggaacaagacatgtggcagtggaaccagaggtagctaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagtagagagaattcactcagcggagtggaaggagaaggactccacaaacttggatatatactcagagacatatcaaagattccagggggaaacatgtatgcagatgacacagccggatgggacacaaggataactgaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtggtgaaaccaattgatgataggtttgcaacagccttaacagctctgaatgatatgggaaaagtgagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattggatcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttagggaaaagggaagatcaatggtgtggatccctgataggcttaacagcaagggccacctgggccaccaacgtacaagtggccataaaccaagtgagaagactaattgggaatgagaattacctagattacatgacatcaatgaagagattcaagaacgagagtgatcccgaaggggcactctggtga

SEQ ID NO: 5793 - RNA, 9879 nt, synthetic construct
  misc_feature 1..9879: note = derived and/or modified CDS sequence (wt) from DENV-1__FJ410262__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgatgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaagggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggactgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaactagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttggtttgtgtgagggtaccacagttgttgtggatgaacattgtggaaatcgaggaccatctcttaggaccacaacagttacaggaaagataattcatgaatggtgttgcagatcttgtacgctaccacccttacgcttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggactgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcattatgcatggaagacaatggccatggtactgtcaattgtatctctcttccccttatgcctgtccacgacctcccaaaaaacaacatggcttccggtgctattgggatctcttggatgcaaaccgctaaccatgtttcttatagcagaaaacaaaatctggggaaggaaaagttggcctctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcttgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagatattcctgagagatcatggaactcaggctatgagtggatcactgacttcccgggcaaaacagtttggtttgttccaagtatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagaccatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgctgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggccatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgatacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaaagaggcacagcacagatcatggaggtgacagccaagtggttatggggttttctttctagaaacaagaaaccaagaatttgcacaagagaggagttcacaagaaaagttaggtctaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaagtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgattcatgcccatcaccaatggatgacaacagaagacatgctgtcagtgtggaatagggtttggatagaggagaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 5794 - RNA, 9879 nt, synthetic construct
  misc_feature 1..9879: note = derived and/or modified CDS sequence (wt) from DENV-1__FJ410263__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacataatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgcaaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggttcaggcggattcaggatgtgtaattaattggaaaggtagagaactcaagtgtggaagtggcatttttgtcaccaatgaagttcacacttggacagagcaatacaaatttcaagctgactcccctaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctcattcatagaagttaaaacatgtatctggccaaaatcccacactctatggagcaatggagttctggaaagtgaaatgataattccaaagatctatggaggaccaatatctcagcacaactacagaccaggatattttacacaagcagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaagaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgttcgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaatcctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgctcagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaataaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggttcgtggagaggaaccttgtgaaaccagaagggaaagtcatagacctcggttgtggaagaggtggctggtcatactattgcgctgggctgaagaaagtcacagaagtgaaggggtatacaaaaggaggacctggacatgaggaaccaatcccaatggcgacctatggatggaacctagtaaagctgcactctgggaaagacgtattttttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggttaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaagccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcggccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5795 - RNA, 9879 nt, synthetic construct
  misc_feature 1..9879: note = derived and/or modified CDS sequence (wt) from DENV-1__FJ410264__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgttgcactggccccacacgtgggacttggtttggaaacaagaaccgaaacgtggatgtcctctgaaggcgcttggaaacagatacaaagagtggagacttgggccctgagacacccaggattcacggtgatagctctttttctagcacatgccataggaacatccatcacccagaaggggatcattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgccgacgaacgtttgtggatagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacattcaagacagctcatgcaaaaaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaatccagaatgggagactgataacagctaatcctatagtcactgacaaagaaaaaccagtcaacattgaggcagaaccgccctttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttctgtaggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggaagagagctcaaatgtggaagtggcatctttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaataccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctccttcatagaagttaaaacatgcatttggccaaaatcccacactctatggagcaatggagttctggaaagtgaaatgataattccaaagatctatggaggaccaatatctcagcacaactacagaccaggatatttcacacaaacagcagggccgtggcacctaggtaaattggaactggattttgatttgtgtgagggtaccacagttgttgtggatgaacattgtggaaatcgaggaccatctcttagaaccacaacagtcacaggaaagataattcatgaatggtgttgcagatcttgtacgctaccacctttacgttttaaaggagaggatgggtgttggtacggcatggaaatcagaccagttaaggaaaaggaagagaatctagtcaaatcaatggtctctgcagggtcaggggaagtggacagcttctcactaggactgctatgcatatcaataatgatcgaagaggtgatgagatccagatggagtagaaaaatgttgatgactggaacactggctgttttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggagatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttataacagaaaacaaaatctggggaaggaaaagttggcccctcaatgaaggaatcatggctgttggagtagtcagcattctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatactagtggaggtccaagatgatggaactatgaagataaaggatgaagagagagatgacacgctaaccattctccttaaagcaactctgctagcagtttcaggggtgtacccattatcaataccagcgaccctttttgtgtggtacttctggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagatctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcctccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgtgagtttaaagagtttgcagcaggaagaagaagcgtctcaggtgatctaatattagaaatagggaagcttccacaacacttgacgcaaagggcccagaatgccttagacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcttaatggtgctgcttattccagagccagacaggcaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttgggatgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgtagatggaattgttgcaatagacttggaccctgtggtctatgatgcaaaatttgagaaacaactaggccaaataatgttgttaatattatgcacttcacagatcctcttgatgaggaccacatgggccttgtgcgaatccatcacactggccactggacctctgaccacgctttgggagggatctccagggaaattttggaacaccacgatagcggtttccatggcaaacattttcagaggaagttatctagcaggagcaggtctggccttctcactaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggttggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacactcttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggctgtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagagagcttcacaaacagggaaaatgtgccacgtgtgtttacaacatgatggggaagagagagaaaaaactaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggaaaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgctcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatacctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 5796 - RNA, 9879 nt, synthetic construct
  misc_feature 1..9879: note = derived and/or modified CDS sequence (wt) from DENV-1__FJ410265__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgcaaagttcaagtgtgtgacaaaactggaaggaaagatagttcaatatgagaacttgaaatattcagtaatagtcaccgttcacaccggagaccagcaccaagtgggaaatgaaagcacagaacatgggacaactgctactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacctggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggttcaggcggattcaggatgtgtaattaattggaaaggtagagaactcaagtgtggaagtggcatttttgtcaccaatgaagttcacacttggacagagcaatacaaatttcaagctgactcccctaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctcattcatagaagttaaaacatgcatctggccaaaatcccacactctatggagcaatggagttctggaaagtgaaatgataattccaaagatctatggaggaccaatatctcagcacaactacagaccaggatattttacacaagcagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcacatcaataatgatcgaggaggtgatgagatccagatggagtagaagaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgttcgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattgtcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaatcctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggttatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgctcagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacacccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacattgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggttcgtggagagaaaccttgtgaaaccagaagggaaagtcatagacctcggttgtggaagaggtggctggtcatactattgcgctgggctgaagaaagtcacagaagtgaaggggtatacaaaaggaggacctggacatgaggaaccaatcccaatggcgacctatggatggaacctagtaaagctgcactctgggaaagacgtattttttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagctctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5797 - RNA, 9879 nt, synthetic construct
  misc_feature 1..9879: note = derived and/or modified CDS sequence (wt) from DENV-1__FJ461336__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttagaaacaagaaccgaaacgtggatgtcctctgaaggcgcttggaaacagatacaaagagtggagacttgggccctgagacacccaggattcacggtgatagctctttttctagcacatgccataggaacatccatcacccagaaagggattattttcattttgttaatgctggtaacaccatccatggccatgcgatgcgtgggaataggcaacagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccactgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacagtggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaagctgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgctcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattagatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacaccctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttgccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaacgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtgggaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgctcagaggagaggaagaattggaaggaaccacaataaggaaggtgatcagtacatctacatgggacagcctttaaacaacgatgaagatcacgctcactggacagaagcaaaaatgctccttgacaatataaacacaccagaagggattatcccagctctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttattattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtaaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacactacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataagaggagtggaattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcaacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacaccacaccctttggacaacagagggtgtttaaagagaaagttgacacacgcacaccaaaagcaaaacggggcacagcacaaatcatggaggtgacagccaagtggttatggggttttctctctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaacattccagggggaaacatgtatgcagatgacacagccggatgggatacaaggataacagaggatgaccttcagaatgaggccagaattactgacatcatggaacctgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacagatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5798 - RNA, 9879 nt, synthetic construct
  misc_feature 1..9879: note = derived and/or modified CDS sequence (wt) from DENV-1__FJ410266__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtaggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagatgtggtactggaacatggaagctgcgtcaccaccatggcgaaagacaaaccaacattggacattgaactcctgaagacggaagtcacaaaccctgccgtcctgcgcaaactgtgcatcgaagctaaaatatcaaacaccaccaccgactcaagatgtccaacacaaggagaagccacactcatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatactcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccaacatggaaccgttttagtgcagattaaatacgaaggaacagatgcaccatgcaagatccctttttcgacccaagatgaaaaaggagtaacccagaatgggagattgataacagctaatcctatagtcactgacaaagaaaaaccagtcaacattgaggcagaaccgccttttggtgagagttacatcgtgataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtacaccagatttttggaactgcatacggagttttgttcagcggtgtttcctggaccatgaaaataggaataggggttctactgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaagttcacacttggacagagcaatataaatttcaagctgactccccaaagagattatcagcagccatcgggaaggcatgggaggagggtgtgtgtggaattcgatcagccactcgtctcgagaatatcatgtggaagcaaatatcaaatgaactgaaccacatcttacttgaaaatgacatgaagttcacagtggttgtaggagatgtagttgggatcttggctcaagggaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaacggagttctggaaagtgaaatgataattccaaagatctatggaggaccaatatctcagcacaactacagaccaggatatttcacacaaacggcagggccgtggcatctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagcaaaaaaatgttgatgactggaacactggctgtgttcctccttctcataatggggcaattgacatggaatgatctgatcagattatgcatcatggttggagccaacgcttccgacaggatggggatgggaacgacgtacctagctctgatagccacttttaaaatgagaccaatgtttgctgtcgggctactattccgtagactaacatccagagaagttctccttcttacaattggattgagtctagtggcatctgtggagttaccaaattccttggaggagctgggggatggacttgcaatgggcattatgattttaaaattattgactgactttcagtcacatcagctgtgggctaccttgctgtcctttacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcacacaatatattagtggaggtccaagatgatggaactatgaagataaaggacgaagagagagatgacacgctaaccattctccttaaagcaactctgctagcagtttcaggggtgtacccactatcaataccagcgaccctttttgtgtggcacttttggcagaaaaagaaacagagatctggagtgctatgggatacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtacttatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagatttcaaacccggcacatctggatctcccatcgtgaacagagaaggaaaaatagtaggtctttatggaaatggagtggtgacaacaagtgggacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcatcctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgtgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcctactctgcgtgatggcttcaagcgtactgctatggatggccagtgtggagccccattggatagcggcctccatcatactggagtttttcctaatggtgctgcttattccagagccagacagacaacgcactccgcaagacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaatcaggcagctatattgatgggacttgacaaaggatggccaatatcgaagatggacataggagttccacttctcgccttagggtgctattcacaggtgaatccactgacgctgacagcggcggtattgatgctagtggctcattacgccataattggacctggactgcaagcaaaggctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctgaccacgctttgggaggggtctccaggaaaattttggaacaccacgatagcggtttccatggcaaacattttcagaggaagttatctagcaggagcaggtctggccttctcattaatgaaatctttaggaggaggtaggagaggcacgggagcccaaggggaaacactgggagagaaatggaaaaggcagctgaaccaactgagcaagtcagaattcaacacttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgatattggtgagtcctctccaaacccaaccatagaagaaggaagaacgttacgtgtcctaaaaatggtggaaccatggctcagagggaaccaattttgcataaaaattctaaatccctatatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacataagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacaccacaccctttggacaacagagggtgttcaaagagaaagttgacacgcgcacaccaaaagcaaaacgaggcacagcacaaatcatggaggtgacagccaaatggttatggggttttctttctagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccggcgaattggagaccccaaatttagccgagagggttctcgactggctggaaaaatatggtgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactgattgggaatgagaattatctagattacatgacatcaatgaagagattcaagaacgagggcgatcccgaaggggcactctggtga

SEQ ID NO: 5799 - RNA, 9879 nt, synthetic construct
  misc_feature 1..9879: note = derived and/or modified CDS sequence (wt) from DENV-1__FJ410269__SS-prME
  source 1..9879: mol_type = other RNA
tctgtgaccatgctgctcatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgtagattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctctaacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacattcaagacagctcatgcaaagaagcaggaagtagtcgtactaggatcacaagaaggagcaatgcacaccgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaatccagaatgggagattgataacagcaaatcctatagtcactgacaaagaaaaaccagtcaacattgaggcagaaccgccttttggtgagagttacatcgtgataggagtaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtgcaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagtcactcgtctcgagaatatcatgtggaagcaaatatcaaatgaactgaaccacatcctacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaacacaaccttcatcatcgacggcccaaacaccccagaatgccctgatgatcaaagagcatggaacatttgggaagttgaggactatggatttggaattttcacgacaaatatatggttgaaattgcgtgactcctacactcaagcgtgtgaccaccggttaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggagagtgaaatggtaattccaaaaatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgtagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgttgatgactggaacattggctgtgttcctccttctcataatggggcaattgacatggaatgatctgatcagattatgcattatggttggagccaacgcttccgacaggatggggatgggaacgacgtacctagctctgatggccacttttaagatgagaccaatgtttgctgtcgggctattattccgtagactaacatccagagaagttctccttcttacaattggattgagtctagtggcatctgtggagataccaaattccttggaagagctgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaacgatgtgccgctagctgggccactaatagctggaggcatgctaatagcatgttatgttatatctggaagctcagctgacttatcactagagaaagcggctgaggtctcctgggaagaagaagcagaacactctggtgcctcgcacaatatattagtggaggtccaagatgatggaactatgaagataaaggatgaagagagagatgacacgctaaccattcttcttaaagcaactctgctagcagtttcaggggtgtatccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccagaggagctgtactcatgtatcaagggaagagactggaaccgagttgggccagtgtcaaaaaagacctgatctcatatggaggaggttggaggcttcaaggatcctggaacacgggagaggaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaaggtcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaactcgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgacaatataaacacaccagaagggattatcccagccctcttcgagccagagagggaaaagagtgcagcaatagacggggaatacagactgcggggtgaagcaaggaagacgtttgtggagctcatgagaagaggagatctacctgtttggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgctttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactgctggaaaccacaaagaaagacttagggattggccatgtggctgttgaaaatcaccaccatgccacaatgctggatgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactgcaagcaaaggctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctaaccacgctttgggagggatctccaggaaaattttggaacaccacgatagcggtttccatggcaaacatttttagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacccggacatgaggaaccaatcccaatggcgacctatggatggaacctagtaaaactgcactccgggaaagacgtattctttacaccacctgagaaatgtgacacacttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaaccgattcacaatggctcacaggaaaccaacatatgaaagagacgtggacctaggcgctggaactagacatgtggcagtggaaccagaggtagccaacttggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaagaaaccaagaatttgcacaagagaggagttcacaaggaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattaccgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaacatggcgtcgaaaggctgaaaagaatggcaatcagcggggatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtgtccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaatgagggtgatcccgaaggggcactctggtga

SEQ ID NO: 5800 - RNA, 9879 nt, synthetic construct
  misc_feature 1..9879: note = derived and/or modified CDS sequence (wt) from DENV-1__FJ410273__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagctttgtgaggacacaatgacttacaagtgccctcgaatcactgaggcggaaccagatgacgttgattgttggtgcaatgccacagacacatgggtgacctatggaacatgttcccaaactggcgagcaccgacgagacaaacgttccgtcgcactagccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattatcttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaacttttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtgatagtcaccgtccacactggagaccagcaccaggtgggaaatgaaagcacagaacacgggacaactgcaactataacacctcaagctccttcgacggaaatacagctgaccgactacggagctcttacattggattgttcacctagaacaggactagacttcaatgaaatggtgttgttgacaatgaaagaaaaatcatggctagtccacaaacaatggtttctagacctaccactgccttggacctcgggagcttcaacatcacaagagacttggaacagacaagatttgcttgtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgtggcaactgccagaggagcacgaaggatggccatactgggagacaccgcatgggactttggttctataggaggagtgttcacgtctgttggaaaattagtacaccagatttttggaactgcatatggagttttgtttagcggtgtttcctggaccatgaaaataggaataggagttctgctaacatggctaggattaaactcaaggagcacgtccctttcgatgacatgcattgcagttggcctagtaacattatacctaggagtcatggttcaggcggattcaggatgtgtaattaattggaaaggcagagaactcaaatgtggaagtggcatttttgtcaccaatgaagttcacacttggacagagcaatacaaatttcaagctgactccccaaagagactatcagctgccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggtcgtaggagatgttgctggaatcttgactcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctagcaagagcctctttcatagaagttaaaacatgtatctggccaaagtcccacactctatggagcaatggagttctggaaagtgaaatgataattccaaagatctatggaggaccaatatctcagcacaactacagaccagggtatttcacacaaacggcagggccgtggcacctaggcaagttggaactggattttaatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgctagctgtaggactattattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgtattccttgcactatgcatggaagacaatggccatggtactgtcaattgtatctctcttccccttatgcctgtccacgacctcccaaaaaacaacatggcttccggtgctattgggatctcttggatgcaaaccactaaccatgtttctcatagcagaaaacaaaatctggggaaggaaaagttggcccctcaatgaaggaatcatggctgttggaatagtcagcattctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggctccaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcccctaccagagattgaaaacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcagttgagcagaaaaacttttgatacagagtaccaaaaaacaaaaaataacgactgggactacgtcgtcacaacagacatctctgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggctcagaatgccttggacaatctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcttagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggatgtagacttacatccagcttcagcctggaccctctatgcagtggccacaacaattatcactcccatgatgaggcacacaatcgaaaacacaacggcaaacatttccctgacagccattgcaaaccaggcggctatattaatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacactacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccagctgagcaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacttagtaaaactgcactccgggaaagacgtattcttcataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaatattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacaaatcatggaggtgacagccaagtggttatggggttttctctctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggggagtttggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcgatctttaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtccgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgactgggtcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaggtggccataaaccaagtgagaagactgattgggaatgagaattatctagattacatgacatcaatgaagagattcaagaacgagagtgatcctgaaggggcactctggtga

SEQ ID NO: 5801 - RNA, 9879 nt, synthetic construct
  misc_feature 1..9879: note = derived and/or modified CDS sequence (wt) from DENV-1__FJ410276__SS-prME
  source 1..9879: mol_type = other RNA
tctgtgaccatgttccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgactgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatcccttttttgacccaagatgaaaaaggagtgacccagaatgggagattgataacagctaaccccatagttactgacaaagaaaaaccagttaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgacttgtgtgagggtaccacagttgttgtggatgaacattgtggaaatcgaggaccatctcttaggaccacaacagtcacaggaaagataattcatgaatggtgttgcagatcttgcacgttaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagctgacctatcattagagaaagcggctgaggtctcctgggaagaagaagcagaacactctggtgcctcacacaatatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctacagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccagagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaatcgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagctatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggttacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagtttacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaacttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatctatgaagagattcaagaacgagagtgatcccgaaggggcactctggtga

SEQ ID NO: 5802 - RNA, 9879 nt, synthetic construct
  misc_feature 1..9879: note = derived and/or modified CDS sequence (wt) from DENV-1__FJ410278__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgcaaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagatctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctaataacactatacctaggagtcatggttcaggcggattcaggatgtgtaattaattggaaaggtagagaactcaagtgtggaagtggcatttttgtcaccaatgaagttcacacttggacagagcaatacaaatttcaagctgactcccctaagagactatcagcagccattgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctcattcatagaagttaaaacatgtatctggccaaaatcccacactctatggagcaatggagttctggaaagtgaaatgataattccaaagatctatggaggaccaatatctcagcacaactacagaccaggatattttacacaagcagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaagaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgttcgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagctggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagagaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaatcctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcactgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgctcagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgctgcaatgctggacgtagacttacatccagcttcagcctggaccctctatgcagtggccacaacaattatcactcccatgatgaggcacacaatcgaaaacacaacggcaaacatttccctgacagccattgcaaatcaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggttcgtggagaggaaccttgtgaaaccagaagggaaagtcatagacctcggttgtggaagaggtggctggtcatactattgcgctgggctgaagaaagtcacagaagtgaaggggtatacaaaaggaggacctggacatgaggaaccaatcccaatggcgacctatggatggaacctagtaaagctgcactctgggaaagacgtattttttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcggcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagactacatgacatcaatgaagagattcaagaacgagagtgatcccgaaggggcactctggtga

SEQ ID NO: 5803 - RNA, 9879 nt, synthetic construct
  misc_feature 1..9879: note = derived and/or modified CDS sequence (wt) from DENV-1__FJ410279__SS-prME
  source 1..9879: mol_type = other RNA
tctgtgaccatgctcctcatgctgatgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttttgtgaggatacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggataagctgactctaaaggggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaatcaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaactgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtacttcttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacaacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcgcacaacatattagtggaggtccaagatgatggaaccatgaagataaaggatgaagagagagatgacacgctaaccattctccttaaagcaactctgctagcagtctcaggggtgtacccattatcaataccagcgaccctttttttgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaggacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattataacatgattatcatggatgaagcacatttcactgatccatccagcatagcggccagagggtacatctcaacccgagtgggcatgggtgaagcagctgcgatcttcatgacagctactcccccaggatcagtggaggcctttccacagagtaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgcccactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagagtatactcagacccactggccctgcgcgagtttaaagagtttgcagcaggaagaagaagcgtctcaggtgatctaatattagaaatagggaaacttccacaacacttgacgcaaagggcccagaatgccttggacaatctggtcatgttgcacaactccgaacaaggaggaagagcctatagacatgcaatggaggaattgccagacaccatagaaacgttgatgctcctagctttgatagctgtgttaactggtggagtgacgctgttcttcctatcaggaagaggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacactttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatacacgaaaggaggacctggacatgaggagccaattccaatggcgacctatggatggaacctagtaaaactgcactccgggaaagatgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccttacatgccaagcgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagctaacctagatatcattggccagaggatagagaacataaaacatgaacataagtcaacatggcattatgatgaggacaatccatacaaaacatgggcctaccatggatcatatgaggtcaagccatcaggatcagcctcatccatggttaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatgggaaagagagagaaaaaactaggagagttcggaaaggcaaaaggaagtcgtgcaatatggtacatgtggctgggagcacgctttctagagttcgaagcccttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaagtcaatcttcaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccaactgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttctgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgccatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatacttaggaaaaagggaagatcaatggtgtggatccctgataggcttaacagcaagggccacctgggccaccaacatacaagtggccataaaccaagtgagaagactaattgggaatgagaattatctagattatatgacatcaatgaagagattcaagaacgagagtgatcctgaaggggcactctggtga

SEQ ID NO: 5804 - RNA, 9879 nt, synthetic construct
  misc_feature 1..9879: note = derived and/or modified CDS sequence (wt) from DENV-1__FJ410283__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagttacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtgacccagaatgggagattgataacagctaaccccatagttactgacaaagaaaaaccagttaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacactgcatgggactttggttctataggaggagtgttcacgtctgctggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatataaatttcaagctgactccccaaagagactatcagcagccatcgggaaggcatgggaggagggtgtgtgtggaattcgatcagcgactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtgggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacttacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcactatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgatccaattgagcaggaaaacctttgatacagagtaccaaaaaacaaaaaacaacgactgggactacgtcgtcacaacagacatctccgaaatgggagcgaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagctatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaacttagccgagagagttctcgactggctgggaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttagggaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5805 - RNA, 9879 nt, synthetic construct
  misc_feature 1..9879: note = derived and/or modified CDS sequence (wt) from DENV-1__FJ410284__SS-prME
  source 1..9879: mol_type = other RNA
tctgtgaccatgctgcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgctggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctggacctaccactgccttggacctcaggagcttcaacatcacaagagacttggaacagacaagatttgctggtgacatttaagacagctcatgcaaagaagcaggaagtagtcgtactaggatcacaagaaggagcaatgcacaccgcgttgaccggagcgacagaaatccaaacgtctggaacgacaacaatctttgcaggacacctgaaatgtagattaaagatggacaaactgactctaaaagggatgtcatatgtgatgtgcacaggctcatttaagctagagaaagaagtggctgagacccagcatggaaccgttttagtgcagattaaatacgaaggaacagatgcaccatgcaagatccctttttcgacccaagatgaaaaaggagtaatccagaatgggagattgataacagcaaatcctatagtcactgacaaagaaaaaccagtcaacattgaggcagaaccgccttttggtgagagttacatcgtgataggagtaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtgcaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaagttcacacttggacagagcaatacaaattccaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaacacaaccttcatcatcgacggcccaaacaccccagaatgccctgatgatcaaagagcatggaacatttgggaagttgaggactatggatttggaattttcacgacaaatatatggttgaaattgcgtgactcctacactcaagcgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggagagtgaaatggtaattccaaaaatctatggaggaccaatatctcagcacaactacagaccaggatatttcacacaaacggcagggccgtggcacctaggtaagttggaactggattttgatttgtgtgagggtactacagttgttgtggatgaacattgtggaaatcgaggaccatctcttagaaccacaacagtcacaggaaagataattcatgaatggtgttgtagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgttgatgactggaacattggctgtgttcctccttctcataatggggcaattgacatggaatgatctgatcagattatgcattatggttggagccaacgcttccgacaggatggggatgggaacgacgtacctagctctgatggccacttttaagatgagaccaatgtttgctgtcgggctattattccgtagactaacatccagagaagttctccttcttacaattggattgagtctagtggcatctgtggagttaccaaattccttggaagagctgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaactatgtttcttatagcagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagctgacttatcactagagaaagcggctgaggtctcctgggaagaagaagcagaacactctggtgcctcgcacaatatattagtggaggtccaagatgatggaactatgaagataaaggatgaagagaaagatgacacgctaaccattcttcttaaagcaactctgctagcagtttcaggggtgtatccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccagaggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaaggtcccctaccagagattgaagatgaggtgtttaggaaaagaaacttaacaataatggacctacatccaggatcggggaaaacaagaagatatctcccagccatagtccgtgaggccacaaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaactcgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggctagtgccgcccagaggagaggaagaattggaaggaaccacaataaggaaggtgatcagtacatctacatgggacagcctttaaacaacgacgaagatcacgctcactggacagaagcaaaaatgctccttgacaatataaacacaccagaagggattatcccagccctcttcgagccagagagggaaaagagtgcagcaatagacggggaatacagactgcggggtgaagcaaggaagacgtttgtggagctcatgagaagaggagatctacctgtttggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgctttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactgcaagcaaaggctactagagaagctcaaaaaaggacagcggccggaataatgaaaaatccaaccgttgatggaattgttgcaatagatttggaccctgtggtctatgatgcaaaatttgagaaacaactaggccaaataatgttgttaatattgtgcacttcacagatcctcttgatgaggactacatgggccttgtgcgaatccatcacactggccactggacctctaaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacacttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacagaaaaccaacatatgaaagagacgtggacctaggcgctggaactagacatgtggcagtggaaccagaggtagccaacttggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaagaaaccaagaatctgtacaagagaggagttcacaaggaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaacatggcgtcgaaaggctgaaaagaatggcaatcagcggggatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagatatgttgtcagtgtggaatagggtttggatagaggaaaacccatggatggaggacaaaacccatgtgtccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 5806 - RNA, 9879 nt, synthetic construct
  misc_feature 1..9879: note = derived and/or modified CDS sequence (wt) from DENV-1__FJ410285__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaaatcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgtcataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgttcgtggacagaggctggggcaatggctgtgggctcttcggaaaaggaagcctaataacgtgtgctaagttcaagtgtgtgacaaaactggaaggaaagatagttcaacatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctctttcattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacgatttttgcaggacacttgaagtgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagttactgacaaagaaaaaccagtcaacattgaggcagaaccgccctttggtgagagttacatcataataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcttggaccatgaaaataggaataggggttctgctgacatggctgggattaaactcaaggagcacgtccctttcgatgacgtgcattgcagttggcctagtaacactatacctaggagtcatggttcaggcggattcaggatgtgtaatcaattggaaaggtagagaactcaaatgtggaagtggcatttttgtcaccaatgaagttcacacttggacagagcaatacaaatttcaagctgactccccaaagagactatcagcagccatcggaaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggccaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattggctgactttcaatcacatcaactgtgggctaccttgctgtccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatccggatctcccattgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaggctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggcaaaacagtatggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagcgccgcccagaggagaggaagaattggaaggaaccacaataaggaaggtgatcagtacatctacatgggacagcctttaaacaacgatgaagatcacgctcactggacagaagcaaaaatgcttcttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggtgaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgcttctagctctgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccggagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtagaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacagatggagtctgagggaatcttttcacccagcgaattagagaccccaaatttagctgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccttgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5807 - RNA, 9879 nt, synthetic construct
  misc_feature 1..9879: note = derived and/or modified CDS sequence (wt) from DENV-1__FJ410286__SS-prME
  source 1..9879: mol_type = other RNA
tctgtgaccatgctccttatgctgatgcctacagccctggcgttccatttgactacacgagggggagagccgcacatgatagtcagcaagcaggaaagaggaaagtcacttttgtttaagacctcagcaggtgtcaatatgtgcacccttatagcgatggatttgggagagttatgtgaggacacaatgacttacaaatgccctcgaatcactgaggcggaaccggatgacgttgattgttggtgcaatgccacagacacatgggtgacctatggaacatgttcccaaactggcgagcaccgacgagaaaaacgttccgtcgcactggccccacacgtgggacttggtttggaaacaagaactgaaacgtggatgtcctctgaaggcgcttggaaacagatacaaagggtagagacttgggccctgagacacccaggattcacggtgatagccctttttctagcacatgccataggaacatctatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacattggtggaagaacaagacgcgaactttgtgtgtcgacgaacgtttgtggacagaggctggggcaatggctgtgggctcttcggaaaaggaagcctactaacgtgtgctaagttcaagtgtgtgacaaaactggaaggaaagatagttcaatatgaaaacttgaaatattcagtaatagtcaccgtccacactggagaccagcatcaggtgggaaatgaaagcacagaacatgggacaactgcaactataacacctcaagctcccacgacggaaatacagctgaccgactacggagctcttacattggattgttcacctagaacaggactagactttaatgaaatggtgttgttgacaatgaaagaaaaatcatggctagtccacaaacaatggtttctagacttaccactgccttggacttcgggagcttcgacatcacaagagacttggaatagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagactcagcatggaaccgttctagtgcagattaaatatgaaggaacagatgcaccatgcaagattcctttttcgacccaagatggaaaaggagtaacccagaatgggagattgataacagccaaccccatagtcactgacaaggaaaaaccagtcaacattgaggcagaaccgccttttggtgagagttacatcgtgataggagcaggtgaaaaagctttgaaactaagctggttcaagaaaggaagtagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctctcgatgacgtgcattgcagttggcctagtaacactatacctaggagtcatggttcaggcggattcaggatgcgtaattaattggaaaggtagagaactcaaatgtggaagtggtatttttgtcaccaatgaagttcacacttggacagagcaatacaaatttcaagctgactccccaaagagactatcagcagccattgggaaggcatgggaggagggtgtgtgtggaattcgatcagcaactcgtctcgagaacatcatgtggaagcaaatatcaaatgaactgaaccacatcttacttgaaaatgacatgaaattcacagtggttgtaggagatgttgctgggatcttggttcaaggaaaaaaaatgattaggccacaacccatggaatacaaatactcgtggaaaagctggggaaaggctaaaatcataggggcagatgtacagaactccaccttcatcattgacggcccaaacaccccagaatgccctgatgaccaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgacatgggctactggatagaaagtgaaaagaacgagacctggaagctggcaagagcctctttcatagaagttaaaacatgcatttggccaaaatcccacactctatggagcaatggagttctggaaagtgaaatgataattccaaagatccatggaggaccaatatctcagcacaactacagaccaggatatttcacacaaacggcagggccgtggcacctaggcaagttggaactggattttgatttgtgtgagggtaccacagtcgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacagttgacatggaatgatctgatcagattatgcatcatggttggagccaacgcttccgacagaatggggatgggaacgacgtacctagctctgatggccacttttaaaatgagaccaatgtttgctgtagggctattattccgcagactaacatccagagaagttcttcttctaacaattggattgagtctagtggcatctgtggagttaccaaattccttggaggagctgggggatggacttgcaatgggcatcatgattttaaaattattgactgactttcaatcatatcagttgtgggctaccttgctgtccttgacatttatcaaaacaacgttttccctgcactatgcatggaagacaatggctatggtactgtcaattgtatctctcttccccttatgcctgtccacgacctcccagaaaacaacatggcttccggtgctattgggatctcttggatgcaaaccactaaccatgtttctaatagcagaaaacaaaatttggggaaggaaaagttggcccctcaatgaagggatcatggctgttggaatagtcagcatcctattaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactcaggtgcctcacacaacatattagtggaggtccaagatgatggaaccatgaagataaaggatgaagagagagatgacacactaaccattctccttaaagcaactctgctagcagtttcaggggtgtacccattatcaataccagcgaccctttttgtgtggcacttttggcagaaaaagaaacagagatctggagtgttgtgggacacacctagccctccagaagtggaaagagcagttcttgatgatggtatctatagaattatgcagagaggactgttgggcaggtcccaagtaggggtgggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggtttcaaggatcctggaacacgggagaagaagtgcaggtgattgctgttgaaccagggaaaaaccccaaaaatgtacaaacagcgccgggcacctttaagacccctgaaggtgaagttggagccattgccctagatttcaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaagtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgagatggcagaagcgctcaagggaatgccaataaggtaccaaacaacagcagtgaagagtgaacacacaggaaaagagatagttgacctcatgtgtcacgctactttcaccatgcgcctcctgtctcccgtgagagttcccaattacaatatgattatcatggatgaagcacatttcaccgatccatccagcatagcggccagagggtacatctcaacccgagtgggcatgggtgaagcagctgcaatcttcatgacagccactcccccaggatcaatggaggcctttccacagagtaacgcagttatccaagatgaggaaagagacattcctgagagatcatggaactcaggctatgagtggatcactgacttcccaggtaaaacagtctggtttgttccaagcattaaagcaggaaatgacattgccaactgcttaagaaagaatggaaaacgagtgattcaattgagcaggaaaacctttgatacagagtatcaaaaaacaaaaaataacgactgggactacgtcgtcacaacagacatctccgaaatgggagcaaatttccgggccgacagggtgatagacccaagacggtgtctgaaaccggtaatattaaaagatggtccagagcgtgtcattttggcaggaccgatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctctttgagccggagagagaaaagagtgcagcaatagacggggaatatagactgcggggtgaagcaaggaaaacgtttgtggagctcatgagaagaggagacctacctgtctggctgtcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatactagaaatagggaaacttccacaacacttgacgcaaagggcccagaatgccttggacaacttggtcatgttgcacaactccgaacaaggaggaagagcctatagacatgcaatggaagaactgccagacaccatagaaacattgatgctccttgctttgatagctgtgttaactggtggagtgacgctgttcttcctatcaggaaagggcctagggaaaacatctatcggcctactctgcgtgatggcttcaagcgtactactatggatggccagtgtggagccccattggatagcggcctccatcatactggagttcttcctaatggtgttgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagccatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccattgatggaattgttgcaatagatttggaccctgtggtttatgatgcaaaatttgagaaacaactaggccaaataatgttgttgatactatgcacatcacagatcctcttgatgcggactacatgggccctgtgtgaatccatcacactggccactggacctctgaccacgctttgggagggatctccaggaaaattttggaacaccacgatagcggtttccatggcaaacatttttagaggaagttatctagcaggagcaggtttggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaactgaggtggtttgtggagaggaaccttgtgaaaccagaagggaaagtcatagaccttggttgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattcttcataccacctgagaaatgtgatacccttttgtgtgatattggtgagtcctctccaaacccaactatagaggaaggaagaacgctacgcgttctaaagatggtggaaccatggctcagaggaaaccaattttgcataaagattctgaatccctatatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgaccggttctgggaccttgtgcacagagagagggagcttcacaaacagggaaaatgtgccacgtgtgtttacaacatgatggggaagagagaaaaaaaactaggagagttcggaaaggcaaaaggaagtcgtgcaatatggtacatgtggttgggagcacgctttctagagtttgaagctcttggtttcatgaacgaagatcactggttcagcagagagaattcactcagcggagtggaaggggaaggacttcacaaacttggatatatactcagagacatatcaaagattccagggggaaacatgtatgcagatgacacagccggatgggatacaaggataacagaggatgacctccagaatgaggccaaaattactgacatcatggaacccgaacatgccctactggctaagtcaatcttcaagctaacctaccaaaataaggtggtaagggtacagagaccagcaaaaaatggaaccgtgatggatgtcatatccagacgtgaccagagaggaagtggccaggttggaacctatggcttaaacactttcaccaacatggaagcccagctgataagacaaatggagtctgagggaatctttttacccaacgaattagagaccccaaatttagccgggagagttctcgactggctggaaaaatatggcgtcgaaaggctgaaaagaatggcaatcagcggagatgactgcgtagtgaaaccaattgatgataggttcgcgacagccttaacagctctgaatgatatgggaaaagtaagaaaagacataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgactgggtcccaaccagccgcaccacctggtcgatccatgcccatcaccaatggatgacaacagaagacatgctgtcagtgtggaatagggtttggatagaggaaaacccatggatggaggacaaaacccgtatatccagttgggaagatgttccatatctaggaaaaagggaagatcaatggtgtggatctctgataggcttaacagcaagggccacctgggccaccaacatacaagtggccataaaccaagtgagaagactaattgggaatgagaattattcagattacatgacatcaatgaagagattcaagaacgagagtgaacccgaaggggcactctggtga

SEQ ID NO: 5808 - RNA, 9879 nt, synthetic construct
  misc_feature 1..9879: note = derived and/or modified CDS sequence (wt) from DENV-1__FJ461339__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaaggaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaagccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgccaagttcaagtgtgtgacaaaactggaaggaaagatagttcaatatgaaaacttgaaatattcagtaatagtcaccgtccacacaggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatttttgcaggacacttaaaatgtagactaaagatggacaagctgactctaaaagggatgtcatatgtaatgtgcacaggctcattcaagctagagaaagaagtggctgagacccagcatggaaccgttctagtacagattaaatatgaaggaacagatgcaccatgcaagatccctttttcgacccaagatgaaaaaggagtaacccagaatgggagactaataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttccataggaggagtgttcacgtctgtcggaaaattagtacaccagatctttggaactgcatatggagtcttgttcagcggtgtttcctggaccatgaaaataggaataggagttctgctgacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggaaggtgtgtgtggaatacgatcagcaactcgtctcgagaacatcatgtggaagcaaatatcaaatgaactgaaccacatcttacttgaaaatgacatgaaactcacagtggttgtaggagatgttgctggaatcttggctcaaggaaaaaaaatgattaggccacaacccatggaatacaaatactcgtggaaaagctggggaaaggctaaaatcataggggcagatgtgcagaataccacattcatcatcgacggcccaaacaccccagaatgccctgatgaccaaagagcatggaacatttgggaagttgaggactatggatttggaattttcacgacaaatatatggctgaaattgcgtgattcccacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggatagcttttcactaggactgctatgcatatcaataatgatcgaagaggtgatgagatccagatggagtagaaaaatgttgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagttcttcttctaacaattggattgagtctagtggcatctgtggagttaccaaattccctggaggagctgggggatggacttgcaatgggcattatgattttgaaattattgaccgactttcaaccacatcagttgtgggctaccttgctgtccttgacatttatcagaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcaaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagagaacgtgttccacacaatgtggcatgtcaccaggggagccgttctcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaacccaaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaggctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggctagagggtacatctcaacccgagtgggcatgggtgaggcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcaattgagcaggaaaacttttgatacagagtaccaaaaaacaaaaaataacgactgggactacgtcgtcacaacagatatctccgaaatgggagcaaatttccgggccgacagggtgatagacccaagacggtgtctgaaaccggtaatactaaaagatggtccagagcgtgtcattttagcaggaccgatgccagtgactgtagccagtgccgcccagaggagaggaagaattggaaggaaccacaataaggaaggtgatcagtacatctacatgggacagcctttaaacaacgatgaagatcatgctcactggacagaagcaaaaatgctccttgacaatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaataaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagagcccagaatgccttggacaacctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatctatcggcctactctgcgtgatagcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggatcggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtactgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagtaggtctggccttctcattaatgaaatctctaggaggaggtaggagaggcacgggagcccaaggggaaacactgggagagaaatggaagagacagctgaaccaactgagtaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatattattgcgccgggctgaagaaagtcacagaagtgaagggatatacaaaaggaggacctggacatgaggagccaattccaatggcgacctatggatggaacctagtaaaactgcactccgggaaagacgtattcttcataccacccgagaaatgtgacacccttttgtgtgatattggtgagtcctctccaaatccaactatagaggaaggaagaacgctacgcgtcctaaagatggtggaaccatggctcagaggaaaccaattttgcataaaaattttgaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatccagaatgttgctaaaccgatttacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaacccatataaaacatgggcctaccatggatcatatgaggtcaagccgtcaggatcagcctcatccatggtcaatggcgtggtgaaactgctcaccaaaccatgggatgtcatccccatggtcacacaaatagccatgactgacaccacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtctacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagacctcaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgacatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatgtatccagttggggagatgttccatatttaggaaaaagagaagatcaatggtgtggatccctgataggcttaacagcaagggccacctgggccaccaacatacaagtggccataaaccaagtgagaagactacttgggaatgagaattatctagattacatgacatcaatgaagagattcaagaatgagagtgatcctgaaggggcactctggtga

SEQ ID NO: 5809 - RNA, 9879 nt, synthetic construct
  misc_feature 1..9879: note = derived and/or modified CDS sequence (wt) from DENV-1__FJ882515__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcaatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccacaaacaatggtttctagacctaccactgccttggacctcaggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggccgagacccagcatggaaccgttttagtgcagattaaatacgaaggaacagatgcaccatgcaagatccctttttcgacccaagatgaaaaaggagtaacccagaatgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctattggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagggagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtgcagaacaccaccttcatcatcgacggcccaaacaccccagaatgccctgatgatcaaagagcatggaacatttgggaagttgaggactatggatttggaattttcacgacaaatatatggttgaaaatgcgtgactcctacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtaggaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaagagctgggagatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcatccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaattatggctgttggagtagtcagcatcctactaagttcacttctaaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttctggcagaaaaagaaacagagatctggagtgctatgggacacacccagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccaggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgttattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagccgtgttgactggtggagtgacgctgttcttcctatcaggaaggggcctagggaaaacatctatcggcttactctgcgtgatggcttcaagcgtactgctatggatggccagtgtggaaccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagccatattgatgggacttgacaaaggatggccaatatcgaagatggacataggagttccacttctcgccttgggatgctattcacaggtgaatccactgacgctgacagcggcggtattgatgctagtggctcactacgccataattggacctggattgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccattacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtgttctttacaccacctgagaaatgtgacacccttttgtgtgacattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaaaagacgtggacctaggcgctggaactagacatgtggcagtggaaccagaagtagccaacctggatatcattggccagaggatagagaacataaaacatgagcacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagtgcaaatcatggaggtgacagccagatggttatggggttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagcgagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaacatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaactgtgatggatgtcatatccagacgtgaccaaagaggaagtggccaggtcggaacttatggcttgaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtgagaaaagatataccacaatgggaaccttcaaaaggatggaatgactggccacaagtgcctcattgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccacgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgaggatgatcccgaaggggcactctggtga

SEQ ID NO: 5810 - RNA, 9879 nt, synthetic construct
  misc_feature 1..9879: note = derived and/or modified CDS sequence (wt) from DENV-1__FJ882517__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatacctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaagaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtgacattatacctaggagtcatggttcaggcggattcaggatgtgtaattaattggaaaggtagagaactcaaatgtggaagtggcatttttgtcaccaatgaagttcacacttggacagaacaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggtcacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctcctgaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagatttcaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggacggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattatgccataattggacctggactgcaagcaaaagctactagagaagctcaaaaaaggacagcggccggaataatgaaaaatccaaccgttgatggaattgttgcaatagatttggatcctgtggtttatgatacaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaatcaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgatttacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggacacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgtaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 5811 - RNA, 9879 nt, synthetic construct
  misc_feature 1..9879: note = derived and/or modified CDS sequence (wt) from DENV-1__JQ287661__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcaatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggtgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccacaaacaatggtttctagacctaccactgccttggacctcaggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggccgagacccagcatggaaccgttttagtgcagattaaatacgaaggaacagatgcaccatgcaagatccctttttcgacccaagatgaaaaaggagtaacccagaatgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctattggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagggagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatgtcatgtggaagcaaatatcaaatgaactgaaccacatcttacttgaaaatgacatgaaattcacagtggttgttggagatgtagttgggatcttggctcaaggaaaaaaaatgattaggccacaacccatggaacacaaatactcgtggaaaagctggggaaaagctaaaatcataggggcagatgtgcagaacaccaccttcatcatcgacggcccaaacaccccagaatgccctgatgatcaaagagcatggaacatttgggaagttgaggactatggatttggaattttcacgacaaatatatggttgaaaatgcgtgactcctacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtaggaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaagagctgggagatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcatccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaattatggctgttggagtagtcagcatcctactaagttcacttctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttctggcagaaaaagaaacagagatctggagtgctatgggacacacccagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccaggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgttattctagcaggaccgatgccagtaactgtggccagtgccgcccagaggagaggaagaattggaaggaaccacaataaggaaggtgatcagtatatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagccgtgttgactggtggagtgacgctgttcttcctatcaggaaggggcctagggaaaacatctatcggcttactctgcgtgatggcttcaagcgtactgctatggatggccagtgtggaaccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagccatattgatgggacttgacaaaggatggccaatatcgaagatggacataggagttccacttctcgccttgggatgctattcacaggtgaatccactgacgctgacagcggcggtattgatgctagtggctcactacgccataattggacctggattgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccattacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggttcgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgacattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaaaagacgtggacctaggcgctggaactagacatgtggcagtggaaccagaagtagccaacctggatatcattggccagaggatagagaacataaaacatgagcacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagtgcaaatcatggaggtgacagccagatggttatggggttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgaaaaaagagagggagcttcacaaacagggaaaatgtgccacgtgtgtttacaacatgatggggaagcgagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaacatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaactgtgatggatgtcatatccagacgtgaccaaagaggaagtggccaggtcggaacttatggcttgaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 5812 - RNA, 9879 nt, synthetic construct
  misc_feature 1..9879: note = derived and/or modified CDS sequence (wt) from DENV-1__FJ882518__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactagccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgttcgtggatagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaggatttgctggtgacattcaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttctgtaggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatctttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaagggaaaaaaatgattaggccacaacccatggaacacaaatactcgtggaaaagctggggaaaagctaaaatcataggggcagatgtacagaacaccaccttcatcatcgacggcccaagcaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttctcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggagatggacttgcaatgggcattatgattttaaaactattgactgactttcagtcacatcagctgtgggctaccttgctgtccttgacatttattaaaacaacgctttccttacactatgcatggaagacaatggctatggtattgtcaattgcatctctcttccccttatgcctgtccacgacctcccaaaaaacaacgtggcttccggtgctattgggatctcttggatgcaaaccactaaccatgtttcttataacagaaaccaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatattagtggtggtccaagatgatggaactatgaagataaaggatgaagagagagatgacacgctaaccattctccttaaagcaactctgctagcagtttcaggggtgtacccattatcaataccagcgaccctttttgtgtggtacttctggcagaaaaagaaacagagatctggagtgctatgggacacacctagccctccagaagtggaaagagcagttcttgatgatggcatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcttggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaagccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcctccaggatcagtggaggcctttccacagagcaatgcagttatccaagatgaggaaagagacattcctgagagatcatggaactcaggatatgagtggatcactgacttcccaggtaagacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacgacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctctttgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgtgagtttaaagagtttgcagcaggaagaagaagcgtctcaggtgatctaatattagaaatagggaagcttccacaacacttgacgcaaagggcccagaatgccctggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttgggatgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatattatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctttgggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattcttcacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatttgtacaagagaggagttcacaagaaaagtcaggtcaaacgcggccattggagcagtgttcgttgatgaaaatcaatggaactcagcaaaagaagcagtggaagatgagcggttctgggaccttgtgcaaaaagagagagagcttcacaaacagggaaaatgtgccacgtgtgtttacaacatgatggggaagagagagaaaaaactaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccaggaggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaatcaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgctcagccgttccagttgattgggtcccaaccagtcgcaccacctggtcgatccatgcccaccaccaatggatgacaacagaagacatgttgtcagtgtggaatagggtttggatagaggaaaatccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 5813 - RNA, 9879 nt, synthetic construct
  misc_feature 1..9879: note = derived and/or modified CDS sequence (wt) from DENV-1__FJ882519__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagccaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctatcggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactagctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtacttcttctaacaattggattgagtctagtggcttctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtgaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttatttatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaagacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccttttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 5814 - RNA, 9879 nt, synthetic construct
  misc_feature 1..9879: note = derived and/or modified CDS sequence (wt) from DENV-1__FJ882520__SS-prME
  source 1..9879: mol_type = other RNA
tctgtgaccatgctccttatgctgatgcctacagccttggcattccatttgactacacgaggaggagagccgcacatgatagttagcaagcaggaaagaggaaagtcacttttgttcaagacctcagcaggtgttaacatgtgcaccctcatagcgatggatttgggagagttatgtgaggacacaatgacttacaaatgtcctcgaattactgaggtggaaccagatgacgttgattgttggtgcaataccacagacacatgggtgacctatggaacatgttcccaaactggcgagcaccgacgagacaagcgttccgtcgcactggccccacacgtgggacttggtttagaaacaagagccgaaacgtggatgtcctctgaaggcgcttggaaacagatacaaaaagtggagacttgggctctgagacacccaggattcacggtgatagccctttttctagcacatgccataggaacatccatcacccagaaagggattattttcattctgttgatgctggtgacaccttccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacattggtggaagaacaagacgcgaactttgtgtgccgacgaacgtttgtggacagaggctggggcaatggttgtggactcttcggaaaaggaagtctgataacgtgtgctaagttcaagtgtgtgacaaaactggaaggaaagatagttcaatatgaaaatttgaaatattcagtaatagtcaccgtccacactggagaccagcaccaggtgggaaatgagagcacagaacatgggacaactgcaactataacacctcaagctcctacgtcggaaatacagctgaccgactacggagctcttacattggactgctcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtccggaacgacaacaatttttgcaggacacctgaaatgtagactaaagatggacaaactgactctaaaagggatgtcatatgtgatgtgcacaggttcattcaagctagagaaagaagtggctgagacccagcatggaaccgttttagtgcagattaaatacgaaggaacagatgcaccatgcaagatccccttttcgacccaagatgaaaaaggagtaacccagaacgggagattgataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatattgggagacaccgcatgggactttggttctataggaggagtgttcacgtctgttggaaaactagtacaccagatttttggaactgcatatggagttttgttcagcggtgtttcctggaccatgaaaataggaataggggttctgctgacatggctaggattaaactcaaggagcacgtccctttcgatgacgtgcattgcagttggtctagtaacactatacctaggagtcatggttcaggcggattcaggatgtgtgattaattggaagggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccacccgtctcgagaatatcatgtggaggcaaatatcaaatgaactgaaccacatcttacttgaaaatgacatgaaattcacagtagttgtaggagatgttgttgggatcttggctcaaggaaaaaagatgattaggccacaacccatggaacacaaatactcatggaaaagctggggaaaagctaaaatcataggggcagatgtacagaacaccaccttcatcatcgatggcccaaacaccccagaatgccctgatgatcaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgatatggggtactggattgaaagtgaaaagaatgagacctggaagctggcaagagcctcttttatagaagttaaaacatgtatctggccaaaatcccacaccctatggagcaatggagttctggaaagtgaaatgataattccaaaaatctatggaggaccaatatctcagcacaactacagaccaggatatttcacacaaacggcagggccgtggcacctaggcaagttggaactggattttgatttatgtgagggtaccacagttgttgtggatgaacattgtggaaatcgaggaccatctcttagaaccacaacagtcacaggaaagataattcatgaatggtgttgcagatcttgcacgctaccacccttacgtttcaaaggagaagatgggtgttggtacggtatggaaatcagaccagtcaaggaaaaggaagagaatctagtcaaatcaatggtctcagcagggtcaggggaagtggacagcttttcactaggactgttatgcatatcaataatgatcgaagaggtgatgagatccagatggagtagaaaaatgctgatgactggaacactggctgtgttcttccttctcataatgggacaattgacatggaatgatctgatcaggtcatgcatcatggttggagccaacgcttccgacaggatggggatgggaacgacgtacctagctttgatggccacttttaaaatgagaccaatgtttgctgtcgggctattattccgcagactaacatccagagaagttcttcttctaacaattggattgagtctagtggcatctgtggagttaccaaattccttggaggagctgggggatggacttgcaatgggcattatgattttaaaattattgactgactttcagtcatatcagctgtgggctaccttgctgtccttgacatttatcaaaacaacgttttccttgcactatgcatggaagacaatggctatggtactgtcaattgtatctctcctccccttatgcctgtccacgacctcccaaaaaacaacatggctcccggtgctattgggatctcttggatgcaaaccactaaccatgtttcttatagcagaaaacaaaatctggggaaggaaaagttggcccctcaatgaaggaatcatggctgttggcatagtcagcatcctactaagttcactcctcaaaaatgatgtgccgctagctgggccactaatagctggaggcatgctaatagcatgttatgttatatcaggaagctcagccgacctatcactagagaaagcggctgaggtttcttgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcaccttcaagacccctgaaggtgaagttggagccattgccttagatttcaaacccggcacatctggatctcctatcgtgaacagagaagggaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcgggaaaaacaagaagatatcttccagccatagtccgtgaggccataaaaaggaagctgcgcacactaattttggctcccacaagggttgtcgcttccgaaatggcagaggcgctcaaggggatgccaataaggtaccaaacaacagcagtgaagagtgaacacacaggaagagagatagttgatcttatgtgtcacgccactttcaccatgcgtctcctgtctcctgtgagagttcccaattacaacatgattatcatggatgaagcacatttcaccgatccatccagcatagcggccagaggatacatctcaacccgagtgggcatgggtgaagcagctgcgatcttcatgacagccactcccccaggatcggtggaagcctttccacagagcaatgcagttatccaagatgaggaaagagacattcctgaaagatcatggaactcaggctatgagtggatcactgacttcccaggtaaaacagtttggtttgttccaagcatcaaatcaggaaatgacattgccaactgcctaagaaagaatgggaaacgggtgattcaattgagcaggaaaacctttgatacagagtaccaaaaaacaaaaaataacgactgggactacgtcgttacaacagacatctccgaaatgggagcaaacttccgggccgacagggtgatagacccaagacggtgtctgaaaccggtaatactaaaagatggtccagagcgtgtcatcttagcaggaccgatgccagtgactgtggccagtgccgcccagaggagaggaagaattggaaggaaccacaataaggaaggtgatcagtacatctacatgggacagcccttaaacaacgatgaagatcacgcccactggacagaagcaaaaatgctccttgataatataaacacaccagaagggattatcccagccctcttcgaaccggagagagaaaagagtgcagcaatagacggggaatacagactgcggggtgaagcaaggaaaacgtttgtggagctcatgagaagaggagatctacctgtctggttgtcctacaaagttgcctcagaaggcttccagtactccgatagaagatggtgctttgacggggaaaggaacaaccaggtgttggaggagaacatggacgtggagatctggacaaaagaaggagaaagaaagaaactacgaccccgctggctagatgccagaacatactcagacccactggccctgcgcgagtttaaagagtttgcagcaggaagaagaagcgtctcaggtgatttaatattagagatagggaaacttccacaacacttgacgcaaagggcccagaatgccttggacaacctggtcatgttgcacaactccgaacaaggaggaagagcctatagacatgcaatggaagaactgccagacactatagaaacgttgatgctcctagctttgatagctgtgttgactggtggagtgacgctgttcttcctatcaggaaggggcctagggaaaacatctatcggcctactctgcgtgatggcttcaagcgcactgctatggatggccagtgtggagccccattggatagcggcctccatcatactggagttcttcttgatggtgctgcttattccagagccagacaggcaacgcactccgcaagacaaccagctggcatatgtggtgataggtttgttattcatgatacttacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaatatttccctgacagctattgcaaaccaggcagccatattgatgggacttgacaaaggatggccaatatcgaagatggacataggagttccacttctagccttggggtgctattcccaagtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgagaaacagctaggccaaataatgttgttgatactatgcacatcacagatcctcttgatgcggactacatgggccttgtgcgaatccatcacactggccactggacctctgaccacgctttgggagggatctccaggaaaattctggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctacaaaaggagtgggataatggaagtggacagatccgaagccaaagagggactaagaagaggagaaacaaccaaacatgcagtgtcgagaggaaccgccaaactgaggtggtttgtggagaggaatcttgtgaaaccagaagggaaagtcatagacctcggttgtggaagaggtggctggtcatactattgcgctgggctgaagaaagtcacagaagtgaagggatacacaaaaggaggacccggacatgaggaaccaatcccaatggcgacctatggatggaacctagtaaagctgcactccgggaaagacgtattctttataccacctgagaaatgtgacacccttttgtgtgatattggtgaatcctctccaaacccaactatagaggaaggaagaacgttacgcgtcctaaagatggtggaaccatggctcagaggaaaccaattctgcataaagattctgaatccctacatgccaagtgtggtggaaaccctggaacaaatgcaaagaaaacatggaggaatgctagtgcgaaatccactttcaagaaattctacccatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaacaagacatgtggcagtggaaccagaggtagccaatctggatatcattggccagaggatagagaacataaaacatgaacacaagtcaacatggcattatgatgaggacaatccatataaaacatgggcctatcatggatcatatgaggtcaagccatcaggatcagcctcatccatggttaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcactgcacaaatcatggaggtgacagccaggtggttatggggctttctttccagaaacaaaaaaccaagaatttgtacaagagaggagttcacaagaaaagttaggtcaaacgcagccattggagcagtgttcgttgatgaaaatcaatggaactcagcaaaagaagcggtggaagatgaacggttctgggaccttgtgcacagagagagggagcttcacaaacagggaaaatgcgccacgtgtgtttacaacatgatggggaagagagagaaaaagctaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaactcggatacatactcagagacatatcaaagattcctgggggaaatatgtatgcagatgacacagccggatgggatacaaggataacagaggatgaccttcagaatgaggccaaaattactgacatcatggagcctgaacatgccctactggctacgtcaatcttcaagctgacctaccaaaataaggtggtaagggtacagagaccagcaagaaatggaaccgtgatggatgtcatatccagacgtgaccagagaggaagtggccaggtcggaacttatggcttaaacactttcaccaacatggaagcccagctaataagacaaatggagtctgagggaatcttttcacccagcgagttggagaccccaaatttagccgagagagttctcgactggctggaaaaacatggcgtcgaaaggctaaaaagaatggcaatcagcggagatgactgcgtggtgaaaccaattgatgacaggtttgcaacagccttatcagctctgaatgatatgggaaaagtaagaaaagatataccacaatgggaaccctcaaaaggatggaatgattggcaacaagtgcctttttgttcacaccacttccaccagctgattatgaaggatggaagggaaatagtggtgccatgccgcaaccaagatgaacttgtgggtagggctagagtatcacaaggtgctggatggagcctgagagaaactgcatgtctaggcaagtcatatgcacaaatgtggcaactgatgtacttccacaggagagacctgagactagccgctaatgctatctgttcagccgttccagttgattgggtcccaaccagccgtaccacctggtcgatccatgcccatcaccaatggatgacaacagaagacatgttgtcagtgtggaatagggtttggatagaggaaaacccatggatggaggacaaaacccatatatccagctggggagatgttccatatttaggaaaaagggaagatcagtggtgtggatccctgataggcttaacagcaagggccacctgggccaccaacatacaagtggccataaaccaagtgagaagactaattgggaatgagaattatttagattacatgacatcaatgaagagattcaagaacgagagtgatcccgaaggggcactctggtga

SEQ ID NO: 5815 - RNA, 9879 nt, synthetic construct
  misc_feature 1..9879: note = derived and/or modified CDS sequence (wt) from DENV-1__FJ882523__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggatacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcttgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagacttcaatgaaatggtgttgttgacaatgaaagaaaaatcatggctagtccataaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagactgataacagctaatcctatagtcactgacgaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttccataggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggtctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaagggaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaatatttgggaagttgaggactatggatttggaattttcacgacaaacatatggttgaaattgcgtgactcctacacccaagtgtgtgaccatcggctaatgtcggctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttctcacaattggattgagtctagtggcatctgtggagttaccaaattccttggaggagctgggggatggacttgcaatgggcattatgattttaaaattattgactgactttcagtcacatcagctgtgggctaccttgctgtccttgacatttatcaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcaccgggcaccttcaagacccctgaaggtgaagttggagccattgccctagattttaaacccggcacatctggatctcccatagtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcctacaagggttgtcgcttccgaaatggcagaggcgctcaagggaatgccaataagataccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaggcagctgcgatcttcatgacagccactcccccaggatcagtggaggcctttccacagagcaatgcagttatccaagatgaggaaagagacatccctgagagatcatggaactcaggatatgagtggatcactgactttccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccaatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactccgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacattgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgcgaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtgaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggattcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaatcactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatcttttcacccagcgaattggagatcccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatgtaccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggcaacctgggcctctaacatacaagtggccataaaccaagtgagaagactaattgggaatgagaattatctagattacatgacatcaatgaagagattcaagaacgagggtgatcccgaaggggcactctggtga

SEQ ID NO: 5816 - RNA, 9879 nt, synthetic construct
  misc_feature 1..9879: note = derived and/or modified CDS sequence (wt) from DENV-1__FJ882524__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggatacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcttgcgcaaactgtgcattgaagctaaaatatcaaacaccaccaccgactcaagatgtccaacacaaggagaagccacacttatggaagaacaagacgcgaactatgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagacttcaatgaaatggtgttgttgacaatgaaagaaaaatcatggctagtccataaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttccataggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggtctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtggttgggatcttggctcaagggaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaatatttgggaagttgaggactatggatttggaattttcacgacaaatatatggttgaaattgcgtgactcctacacccaagtgtgtgaccatcggctaatgtcggctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttctcacaattggattgagtctagtggcatctgtggagttaccaaattccttggaggagctgggggatggacttgcaatgggcattatgattttaaaattattgactgactttcagtcacatcagctgtgggctaccttgctgtccttgacatttatcaaaacaacgctttccttacactatgcatggaagacaatggctatggtactgtcaattgtatctctcttccccttatgcctatccacgacctctcaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcaccgggcaccttcaagacccctgaaggtgaagttggagccattgccctagattttaaacccggcacatctggatctcccatagtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcctacaagggttgtcgcttccgaaatggcagaggcgctcaagggaatgccaataagataccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaggcagctgcgatcttcatgacagccactcccccaggatcagtggaggcctttccacagagcaatgcagttatccaagatgaggaaagagacatccctgagagatcatggaactcaggatatgagtggatcactgactttccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccaatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactccgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacattgatgctcctagctttgatagctgtgttgactggtggagtgacgctgttcttcctatcaggaaggggcctagggaaaacatctatcggcttactctgcgtgacggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgcgaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtgaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggattcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaatcactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatcttttcacccagcgaattggagatcccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatgtaccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggcaacctgggcctctaacatacaagtggccataaaccaagtgagaagactaattgggaatgagaattatctagattacatgacatcaatgaagagattcaagaacgagggtgatcccgaaggggcactctggtga

SEQ ID NO: 5817 - RNA, 9879 nt, synthetic construct
  misc_feature 1..9879: note = derived and/or modified CDS sequence (wt) from DENV-1__FJ882525__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttgtagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattagatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcgtatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataataggacaattgacatggaatgacttgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacattcatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggagaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtatccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgttacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaattttgtgaaaccagaagggaaagtcatagacctcggttgtggaagaggtggctggtcatactattgcgccgggctgaagaaagtcacagaagtgaagggatatacgaaaggaggacctggacatgaagagccaattccaatggcgacctatggatggaacctagtaaaactgcactccgggaaagacgtgttctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcgaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagattatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 5818 - RNA, 9879 nt, synthetic construct
  misc_feature 1..9879: note = derived and/or modified CDS sequence (wt) from DENV-1__FJ882526__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatctatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctctcacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaagagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagtgcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgacggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgatccaattgagcagaaaaacttttgatacagagtaccaaaaaacaaaaaacaacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataacataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgataaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaattctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattacagacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatctagttggggagatgttccatatttaggaaaaagggaagatcaatggtgtggatccctgataggcttaacagcaagggccacctgggccaccaacatacaagtggccataaaccaagtgagaagactaattgggaatgagaactatctagattacatgacatcaatgaagagattcaagaacgagagtgatcctgaaggggcactctggtga

SEQ ID NO: 5819 - RNA, 9879 nt, synthetic construct
  misc_feature 1..9879: note = derived and/or modified CDS sequence (wt) from DENV-1__FJ882527__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgatgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaagggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaactagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgcttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgcttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacctcccaaaaaacaacatggcttccggtgctattgggatctcttggatgcaaaccactagccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcttgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggcaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagaccatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgctgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggccatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgatacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaaagaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaagtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 5820 - RNA, 9879 nt, synthetic construct
  misc_feature 1..9879: note = derived and/or modified CDS sequence (wt) from DENV-1__FJ882529__SS-prME
  source 1..9879: mol_type = other RNA
tctgtgaccatgctcctcatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggttcctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggataagctgactctaaaggggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcggcagccatcgggaaggcatgggaggagggtgtgtgtggaatacgatcagcaactcgtctcgagaacatcatgtggaagcaaatatcaaatgaactgaaccacatcttacttgaaaatgacgtgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaactgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtacttcttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacaacctcccaaaaaacaacatggcttccggtgctattgggatctcttggatgcaaaccactaaccatgtttcttatagcagaaaacaaaatttggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcagatcccaagtaggggtaggagttttccaagaaaacgtgttccacacaatgtggcatgtcaccaggggagctgtactcatgtatcaagggaagagactggaaccgagctgggccagtgtcaaaaaggacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgtctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagtaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagatggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagagagaaagaaactaagaccccgctggctggatgctagaacatactcagacccactggccctgcgtgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaattgccagacaccatagaaacgttgatgctcctagctttgatagctgtgttaactggtggagtgacgctgttcttcctatcaggaagaggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaatacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaattctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctaaaccaactgagcaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggttcacaggaaaccaacgtatgaaagagacgtggacctaggcgccggaacaagacatgtggcagtggaacctgaggtagctaacctagatatcattggccagaggatagagaacataaaacatgaacataagtcaacatggcattatgatgaggacaatccatacaaaacatgggcctaccatggatcatatgaggtcaagccatcaggatcagcctcatccatggttaatggcgtggtgaaactgctcaccaaaccatgggatgtcatccccatggtcacacaaatagccatgaccgacactacaccctttggacaacagagggtgttcaaagagaaagttgacacacgcacaccaaaagcaaaacgaggcacagcacaaatcatggaggtaacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatacttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 5821 - RNA, 9879 nt, synthetic construct
  misc_feature 1..9879: note = derived and/or modified CDS sequence (wt) from DENV-1__FJ882530__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgatgttgattgttggtgcaatgccacagacacatgggtgacctatggaacatgttcccaaactggcgagcaccggcgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaagggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaactagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcccacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgcttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcttgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggcaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagaccatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgctgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggccatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgatacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaaagaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaagtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagctgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 5822 - RNA, 9879 nt, synthetic construct
  misc_feature 1..9879: note = derived and/or modified CDS sequence (wt) from DENV-1__GQ868605__SS-prME
  source 1..9879: mol_type = other RNA
tctgtgaccatgctacttatgctgatgcccacagccttggcgtttcatctgactacacgagggggagagccgcatatgatagttaccaagcaggaaagaggaaagtcacttttgtttaagacctcagtaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagcccttttcctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaggacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaatttgaaatattcagtaatagtcaccgtccacactggagaccagcaccaggtgggaaatgaaagcacagaacatgggacaaccgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacaccgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagattgataacagcaaatcctatagtcactgacaaagaaaaaccagtcaacattgaggcagaaccgccttttggtgagagttacatcgtgataggagtaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtgcaccagatttttggaactgcatatggagttttgttcagcggtgtttcctggaccatgaaaataggaataggggttctgctgacatggctaggattaaactcaaggagcacgtccctttcaatgacgtgcatcgcagttggcctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaacatcatgtggaagcaaatatcaaatgaactgaaccacatcttacttgaaaacgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacactcaagtgtgtgaccaccggctaatgtcagctgccatcaaggacagcaaggcagttcatgctgacatggggtactggatagaaagtgaaaagaacgatacctggaagctggcaagagcctctttcatagaagttaaaacatgcatttggccaaaatcccatactctatggagcaatggagttctggaaagtgaaatgataattccaaagatctatggaggaccaatatctcagcacaactacagaccaggatatttcacacaaacggcagggccgtggcatctaggtaagttggaactggattttgatttgtgtgagggtaccacagttgttgtggatgaacattgtggaaatcgaggaccatcccttagaaccacaacagtcacaggaaagataattcatgaatggtgttgcagatcttgtacactaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctaagcatatcaataatgatcgaagaggtgatgagatccagatggagtagaaaaatgctgatgactggaacactggctgtgttcctccttctcatagtggggcaattgacatggaatgatctgatcagattatgcatcatggttggagccaacgcttccgacaggatggggatgggaacgacgtacctagctctgatggccacttttaagatgagaccaatgtttgctgtcgggctattattccgtagactaacatccagagaagttctccttcttacaattggattgagtctagtggcatctgtggagttaccaaattccttggaagagctgggggatggacttgcaatgggcattatgattttaaaattattgactgactttcagtcacatcagctgtgggctaccttgctgtctttgacatttattaaaacagcgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatattagtggaggtccaagatgatggaactatgaagataaaggatgaagagagagatgacacgctaaccattctcctcaaagcaactctgctagcagtttcaggggtgtacccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagctatagtccgtgaggccataaaaaggaagctgcgcacactaattttggctcctacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgaaacagagtaccaaaaaacaaaaaataacgattgggactatgtcgtcacaacagacatctccgaaatgggagcaaacttccgagccgacagggtgatagacccaagacggtgtctgaaaccggtaatactaaaagatggttcagagcgtgtcattctagcaggaccgatgccagtaactgtggccagtgccgcccaaaggagaggaagaattggaaggaaccacaataaggaaggtgatcagtacatctacatgggacagcctttaaacaacgacgaagatcacgctcactggacagaagcaaaaatgctccttgacaatataaacacaccagaagggattatcccagccctcttcgagccagagagggaaaagagtgcagcaatagacggggaatacagactgcggggtgaagcaaggaagacgtttgtggagctcatgagaagaggagatctacctgtttggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaataatagaaatagggaaacttccacaacatttgacgcaaaaggcccagaatgctttggacaacctggtcatgttgcacaactccgaacaaggaggaagagcctatagacatgcaatggaagaattgccagacaccatagaaacgttgatgctcctagctttgatagctgtattgactggtggagtgacgctgttcttcctatcaggaaggggcctagggaaaacatctatcggcttactctgcgtgatggcatcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggacttctggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctaaccacgctttgggagggatctccaggaaaattttggaacaccacgatagcggtttccatggcaaacattttcagaggaagttatctagcaggagcaggcctggccttctcattaatgaaatctttaggaggaggtaggagaggcacgggagcccaaggagaaacactgggagagaaatggaaaaggcagctgaaccaactgagcaagtcagaattcaacatctacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggagttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggcttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaacatggcgtcgaaaggctgaaaagaatggcaatcagcggggatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 5823 - RNA, 9879 nt, synthetic construct
  misc_feature 1..9879: note = derived and/or modified CDS sequence (wt) from DENV-1__FJ882534__SS-prME
  source 1..9879: mol_type = other RNA
tctgtgaccatgctccttatgctgatgcctacagccttggcgttccatttgaccacacgagggggagagccgcacatgatagtcagcaagcaggaaagaggaaagtcacttttgtttaagacctcagcaggtgtcaacatgtgcacccttatagcgatggatttgggagagctatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggatttacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagtttaagtgtgtgacaaaactggaaggaaagatagtccaatatgaaaacttgaaatactcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgtactaggaccacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaggtggctgagacccagcatggaaccgttctagtgcagatcaaatacgaaggaacagatgcaccatgcaagatccccttttcgacccaagatgagaaaggagtaacccagaatgggagattgataacagccaaccccatagtcactgacaaagaaaaaccagtcaacattgaggcagaaccgccttttggtgagagttacatcgtgataggagcaggtgaaaaagctttgaagctaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagtcggcctagtaacgctatacttaggagtcatggttcaggcggattcaggatgtgtaattaactggaaaggtagagaactcaaatgtggaagtggcatttttgttaccaatgaagttcatacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaactcacagtggttgtaggagatgttgctgggatcttgggccaaggaaaaaaaatgattaggccacaacccatggaatataaatactcgtggaaaagctggggaaaggctaaaatcataggggcagatgcacagaacaccaccttcatcatcgacggcccaaacaccccggaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgagaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcctccgacaggatggggatgggaacgacgtatctagctctgatggccacttttaaaatgagaccaatgtttgctgtggggctgctattccgcagactaacatccagagaagttcttcttctaacaattggattgagtctagtggcatctgtggagttaccaaattccttggaggagctgggggatggacttgcaatgggcattatgattttaaaattgttgactgactttcaatcacatcagctgtgggctaccttgctgtccttgacatttatcaaaacaacattttctttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagtagaaaacaaaatttggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatactagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcgaggatcctggaacacgggagaagaagtgcaggtgattgctgttgaaccagggaaaaaccccaaaaatgtacaaacggcgccgggcacctttaagacccctgaaggcgaagttggagccattgctctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcgggaaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacattttacagatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcaccgacttcccaggcaaaacagtttggtttgttccaagcattaaatcaggaaatgacattgccaactgcttaagaaagaatgggaagcgggtgattcaattgagcaggaaaacctttgacacagagtaccaaaaaacaaaaaataacgactgggactacgtcgtcacaacagacatctctgaaatgggagcgaatttccgggccgacagggtgatagacccaagacggtgtctgaaaccggtaatactaaaggatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcagtagacggggaatacagactgcgaggtgaagcaaggaaaacgtttgtggagctcatgagaagaggagatctacctgtctggctatcctacaaagttgcttcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaataggaaaacttccacaacacttgacgcaaagggcccagaatgccttggacaatctggttatgctgcacaattccgaacaaggaggaagagcctatagacatgcaatggaagaactgccagacaccatagaaacgttaatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacagcaaacatttccctgacagccattgcaaaccaggcagctatattgatgggacttgacaaaggatggccaatatcgaagatggacataggggttccacttctcgctttggggtgctattcccaggtgaatccactgacgctgacagcggcggtattgatgctagtggcccattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatttagcaggagcaggtctggccttctcattaatgaaatctctaggaggaggtaggagaggcacaggagcccaaggggaaacactgggagagaaatggaaaagacagctgaaccaactgagcaagtcagaattcaacacctataaaaggagtgggattatggaagtggacagatctgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaggtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcctctccaaacccaactatagaggaaggaagaacgctacgcgtcctaaagatggtggagccatggctcagaggaaaccaattctgcataaaaattctgaatccctacatgccaagtgtggtggaaactctggagcaaatgcaaagaaaacatggaggaatgctagtgcgaaatccactttcaagaaattctacccatgaaatgtattgggtttcatgtggaacaggaaacattgtgtcagcagtaaacatgacatccagaatgttgctaaatcgattcacaatggctcacaggaaaccaacatatgaaagagacgtggacctaggcaccggaacaagacatgtggcagtggaaccagaggtagccaacctagatattattggccagaggatagagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttgggcaacagagggtgtttaaagagaaagttgacacacgcacaccaaaagcaaaacgaggtacagcacaaatcatggaggtgacagccaggtggttatggggttttctttctagaaacaagaaaccaagaatttgtacaagagaggagttcacaagaaaagttaggtcaaacgcagccatcggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagtttggaaaggcaaaaggaagtcgtgcaatatggtacatgtggttgggagcacgttttctagagttcgaagctcttggcttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgttatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagctcttgattggctggaaaaatatggcgtcgaaaggctaaaaagaatggcaatcagtggagatgattgcgtagtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacaggagagacctaagactagccgctaatgctatctgttcagccgttccagttgattgggtcccaactagccgcaccacctggtcgatccatgcccatcaccaatggatgacaacagaagacatgctgtcagtgtggaatagggtttggatagaggaaaacccatggatggaggacaaaacccatatatccagctgggaagatgttccatatttagggaaaagggaagatcaatggtgtggatccctgataggcttaacagcaagggccacctgggccaccaacatacaagtggctataaaccaagtgagaagactaattgggaatgagaattatctagattacatgacatcaatgaagagattcaagaacgagagtgaccccgaaggggcactctggtga

SEQ ID NO: 5824 - RNA, 9879 nt, synthetic construct
  misc_feature 1..9879: note = derived and/or modified CDS sequence (wt) from DENV-1__FJ882536__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgttcaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagtttaagtgtgtgacaaaactggaaggaaaaatagtccaatatgaaaacttgaaatactcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccccttttcgacccaagatgagaaaggagtaacccagaatgggagattgataacagccaaccccatagtcactgacaaagaaaaaccagtcaacattgaggcagaaccgccttttggtgagagttacatcgtgataggagcaggtgaaaaagctttgaagctaagctggttcaagaaaggaagcagcatagggaaaatgtttgaggcaactgccagaggagcgcgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagtcggcctagtaacgctatacttaggagtcatggttcaggcggattcaggatgtgtaattaactggaaaggtagagaactcaaatgtggaagtggcatttttgttaccaatgaagttcatacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaactcacagtggttgtaggagatgttgctgggatcttgggccaaggaaaaaaaatgattaggccacaacccatggaatataaatactcgtggaaaagctggggaaaggctaaaatcataggggcagatgcacagaacaccaccttcatcatcgacggcccaaacaccccggaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttcttataatgggacaattgacatggaatgatctgatcagattatgcatcatggttggagccaacgcctccgacaggatggggatgggaacgacgtatctagctctgatggccacttttaaaatgagaccaatgtttgctgtggggctgctattccgcagactaacatccagagaagttcttcttctaacaattggattgagtctagtggcatctgtggagttaccaaattccttggaggagctgggggatggacttgcaatgggcattatgattttaaaattgttgactgactttcaatcacatcagctgtgggctaccttgctgtccttgacatttatcaaaacaacattttctttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatttggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcgaggatcctggaacacgggagaagaagtgcaggtgattgctgttgaaccagggaaaaaccccaaaaatgtacaaacggcgccgggcacctttaagacccctgaaggcgaagttggagccattgctctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacattttacagatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcaccgacttcccaggcaaaacagtttggtttgttccaagcattaaatcaggaaatgacattgccaactgcctaagaaagaatgggaagcgggtgattcaattgagcaggaaaacctttgacacagagtaccaaaaaacaaaaaataacgactgggactacgtcgtcacaacagacatctccgaaatgggagcgaatttccgggccgacagggtgatagacccaagacggtgtctgaaaccggtaatactaaaggatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcagtagacggggaatacagactgcgaggtgaagcaaggaaaacgtttgtggagctcatgagaagaggagatctacctgtctggctatcctacaaagttgcttcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggttatgctgcacaattccgaacaaggaggaagagcctatagacatgcaatggaagaactgccagacaccatagaaacgttaatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacagcaaacatttccctgacagccattgcaaaccaggcagctatattgatgggacttgacaaaggatggccaatatcgaagatggacataggggttccacttctcgctttggggtgctattcccaggtgaatccactgacgctgacagcggcggtattgatgctagtggcccattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacccctgaccacgctttgggagggatctccaggaaaattttggaacaccacgatagcggtttccatggcaaacattttcagaggaagttatttagcaggagcaggtctggccttctcattaatgaaatctctaggaggaggtaggagaggcacgggagctcaaggggaaacactgggagaaaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaggtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcctctccaaacccaactatagaggaaggaagaacgctacgcgtcctaaagatggtggagccatggctcagaggaaaccaattctgcataaaaattctgaatccctacatgccaagtgtggtggaaactctggagcaaatgcaaagaaaacatggaggaatgctagtgcgaaatccactttcaagaaattctacccatgaaatgtattgggtttcatgtggaacaggaaacattgtgtcagcagtaaacatgacatccagaatgttgctaaatcgattcacaatggctcacaggaaaccaacatatgaaagagacgtggacctaggcaccggaacaagacatgtggcagtggaaccagaggtagccaacctagatattattggccagaggatagagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttgggcaacagagggtgtttaaagagaaagttgacacacgcacaccaaaagcaaaacgaggcacagcacaaatcatggaggtgacagccaggtggttatggggttttctttctagaaacaagaaaccaagaatttgtacaagagaggagttcacaagaaaagttaggtcaaacgcagccatcggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagtttggaaaggcaaaaggaagtcgtgcaatatggtacatgtggttgggagcacgttttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgttatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagctctcgattggctggaaaaatatggcgtcgaaaggctaaaaagaatggcaatcagtggagatgattgcgtagtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacaggagagacctaagactagccgctaatgctatctgttcagccgttccagttgattgggtcccaactagccgcaccacctggtcgatccatgcccatcaccaatggatgacaacagaagacatgctgtcagtgtggaatagggtttggatagaggaaaacccatggatggaggacaaaacccatatatccagctgggaagatgttccatatttagggaaaagggaagaccaatggtgtggatccctgataggcttaacagcaagggccacctgggccaccaacatacaagtggctataaaccaagtgagaagactaattgggaatgagaattatctagattacatgacatcaatgaagagattcaagaacgagagtgatcctgaaggggcactctggtga

SEQ ID NO: 5825 - RNA, 9879 nt, synthetic construct
  misc_feature 1..9879: note = derived and/or modified CDS sequence (wt) from DENV-1__FJ882537__SS-prME
  source 1..9879: mol_type = other RNA
tctgtgaccatgctccttatgctgatgcctacagccttggcattccatttgactacacgaggaggagagccgcacatgatagttagcaagcaggaaagaggaaagtcacttttgttcaaaacctcagcaggtgtcaacatgtgcaccctcatagcgatggatttgggagagttatgtgaggacacaatgacttacaaatgtcctcgaattactgaggtggaaccagatgacgttgattgttggtgcaacaccacagacacatgggtgacctatggaacatgttcccaaactggcgagcaccgacgagacaagcgttccgtcgcactggccccacacgtgggacttggtttagaaacaagagccgaaacgtggatgtcctctgaaggcgcttggaaacagatacaaaaagtggagacttgggccctgagacacccaggattcacggtgatagccctttttctagcacatgccataggaacatccatcacccagaaagggattattttcattctgttaatgctggtaacaccttccatggccatgcgatgcgtgggaataggcagcagggacttcgtggaagggctgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacattggtggaagaacaagacgcgaactttgtgtgccgacgaacgtttgtggacagaggctggggcaatggctgtgggctcttcggaaaaggaagcctgataacgtgtgctaagttcaagtgtgtgacaaaactggaaggaaagatagttcaatatgaaaatttgaaatattcagtaatagtcaccgtccacactggagaccagcaccaggtgggaaatgaaagcacagaacatgggacaattgcaactataacacctcaagctcctacgtcggaaatacagctgaccgactacggagctcttacattggactgctcacctagaacaggactggactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgaccggaacgacaacaatttttgcaggacacctgaaatgtagactaaagatggacaaactgactctaaaagggatgtcatatgtgatgtgcacaggttcattcaagctagagaaagaagtggctgagacccagcatggaaccgttctagtgcagattaaatacgaaggaacagatgcaccatgcaagatccctttttcgacccaagatgaaaaaggagtaacccagaacgggagattgataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaactagtacaccagatttttggaactgcatatggagttttgttcagcggtgtttcctggaccatgaaaataggaataggggttctgctgacatggctaggattaaactcaaggagcacgtccctttcgatgacgtgcattgcagttggtctaataacactatacctaggagtcatggttcaggcggattcaggatgtgtaattaattggaagggtagagaactcaaatgtggaagtggcatttttgtcaccaatgaagtccacacttggacagagcaatacaaatttcaagctgactccccaaagagactatcagcagccatcgggaaggcatgggaggagggtgtgtgtggaattcgatcagccacccgtctcgagaatatcatgtggaggcaaatatcaaatgaactgaaccacatcttacttgaaaatgacatgaaattcacagtagttgtaggagatgttgttgggatcttggctcaaggaaaaaagatggttaggccacaacccatggaacacaaatactcgtggaaaagctggggaaaagccaaaatcataggggcagatgtacagaacaccaccttcatcatcgatggcccaaacaccccagaatgccctgatgatcaaagagcatggaacatttgggaagttgaggactatggatttggaattttcacgacaaacatatggctgaaattacgtgactcctacacccaagtatgtgaccaccggctaatgtcagctgccatcaaggacagcaaggcagttcacgctgatatggggtactggatagaaagtgaaaagaatgagacctggaagttggcaagagcctcttttatagaagttaaaacatgtatctggccaaaatcccacaccctatggagcaatggagttctggaaagtgaaatgataattccaaaaatctatggaggaccaatatctcagcacaactacagaccaggatatttcacacaaacggcagggccgtggcacctaggcaagttggaactggattttgatttatgtgagggtaccacagttgttgtggatgaacattgtggaaatcgaggaccatctcttagaaccacaacagtcacaggaaagataattcatgaatggtgttgcagatcttgcacgctaccacccttacgtttcaaaggagaagatggatgttggtacggtatggaaatcagaccagtcaaggaaaaggaagagaatctagtcaaatcaatggtctcagcagggtcaggggaagtggacagcttttcactaggactgttatgcatatcaataatgatcgaagaggtgatgagatccagatggagtagaaaaatgctgatgactggaacattggctgtgttcttccttctcataatgggacaattgacatggaatgatctgatcaggtcatgcatcatggttggagccaacgcttccgacaggatggggatgggaacgacgtacctagctttgatggccacttttaaaatgagaccaatgtttgctgtcgggctattattccgcagactaacatccagagaagttcttcttctaacaattggattgagtctagtggcatctgtggagttaccaaattccttggaggagctgggggatggacttgcaatgggcattatgattttaaaattattgactgactttcagtcatatcagctgtgggctaccttgctgtccttgacatttatcaaaacaacgttttccttgcactatgcatggaagacaatggctatggtactgtcaattgtatctctcctccccttatgcctgtccacgacctcccaaaaaacaacgtggctcccggtgctattgggatctcttggatgcaaaccactaaccatgtttcttatagcagaaaacaaaatctggggaaggaaaagttggcccctcaatgaaggaatcatggctgttggcatagtcagcatcctactaagttcactcctcaaaaatgatgtgccgctagctgggccactaatagctggaggcatgctaatagcatgttatgttatatcaggaagctcagccgacctatcactagagaaagcggctgaggtctcttgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcactttcaagacccctgaaggtgaagttggagccattgccttagatttcaaacccggcacatctggatctcctatcgtgaacagagaagggaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcgggaaaaacaagaagatatcttccagccatagtccgtgaggccataaaaaggaagctgcgcacactaattttggctcccacaagggttgtcgcttccgaaatggcagaggcgctcaaggggatgccaataaggtaccaaacaacagcagtgaagagtgaacacacaggaagagagatagttgatcttatgtgtcacgccactttcaccatgcgtctcctgtctcctgtgagagttcccaattacaacatgattatcatggatgaagcacatttcaccgatccatccagcatagcggccagaggatacatctcaacccgagtgggcatgggtgaagcagctgcgatcttcatgacagccactcccccaggatcggtggaagcctttccacagagcaatgcagttatccaagatgaggaaagagacattcctgaaagatcatggaactcaggctatgagtggatcactgacttcccaggtaaaacagtttggtttgttccaagcatcaaatcaggaaatgacattgccaactgcctaagaaagaatgggaaacgggtgattcaattgagcaggaaaacctttgatacagagtaccaaaaaacaaaaaataacgactgggactacgtcgttacaacagacatctccgaaatgggagcaaacttccgggccgacagggtgatagacccaagacggtgtctgaaaccggtaatactaaaagatggtccagagcgtgtcatcttagcaggaccgatgccagtgactgtggccagtgccgcccagaggagaggaagaattggaaggaaccacaataaggaaggtgaccagtacatctacatgggacagcctttaaacaacgatgaagatcacgcccactggacagaagcaaaaatgctccttgataatataaacacaccagaagggatcatcccagccctcttcgaaccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactccgacagaagatggtgctttgacggggaaaggaacaaccaggtgttggaggagaacatggacgtggagatctggacaaaagaaggagaaagaaaaaaactacgaccccgctggctagatgccagaacatactcagacccactggccctgcgcgagtttaaagagtttgcagcaggaagaagaagcgtctcaggtgatttaatattagaaatagggaaacttccacaacacttgacgcaaagggcccagaatgccttggacaacctggtcatgttgcacaactccgaacaaggaggaagagcctatagacatgcaatggaagaactgccagacactatagaaacgttgatgctcctagctttgatagctgtgttgactggtggagtgacgctgttcttcctatcaggaaggggcctagggaaaacatctatcggcctactctgcgtgatggcttcaagcgcactgctatggatggccagtgtggagccccattggatagcggcctccatcatactggagttcttcttgatggtgctgcttattccagagccagacagacaacgcactccgcaagacaaccagctggcatatgtggtgataggtttgttattcatgatacttacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctagccttggggtgctattctcaagtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccccgtggtttatgatgcaaaatttgagaaacaattaggccaaataatgttgttgatactatgcacatcacagatccttttgatgcggactacatgggccttgtgcgaatccatcacactggccactggacccctgaccacgctttgggagggatctccaggaaaattctggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctacaaaaggagtgggataatggaagtggacagatccgaagccaaagagggactaagaagaggagaaacaaccaaacatgcagtgtcgagaggaaccgccaaactgaggtggtttgtggagaggaatcttgtgaaaccagaagggaaagtcatagacctcggttgtggaagaggtggctggtcatactattgcgctgggctgaagaaagtcacagaagtgaagggatacacaaaaggaggacccggacatgaggaaccaatcccaatggcgacctatggatggaacctagtaaagctgcactccgggaaagacgtattctttataccacctgagaaatgtgacacccttttgtgtgatattggtgaatcctctccaaacccaactatagaagaaggaagaacgttacgcgtcctaaagatggtggaaccatggctcagaggaaaccaattctgcataaagattctgaatccttacatgccaagtgtggtggaaaccctggaacatatgcaaagaaaacatggaggaatgctagtgcgaaatccactttcaagaaattctacccatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaacaagacatgtggcagtggaaccagaggtagccaatctggatatcattggccagaggatagagaacataaaacatgaacacaagtcaacatggcattatgatgaggacaatccatataaaacatgggcctatcatggatcatatgaggtcaagccatcaggatcagcctcatccatggttaatggcgtggtgaaactgctcaccaaaccatgggatgtcatccctatggtcacacaaatagccatgactgacaccacaccctttggacaacagagggtgtttaaagagaaagttgacacacgtacaccaaaagcaaaacgaggcactgcacaaatcatggaggtgacagccaggtggttatggggctttctttccagaaacaaaaaaccaagaatttgtacaagagaggagttcacaagaaaagttaggtcaaacgcagccattggagcagtgttcgttgatgaaaatcaatggaactcagcaaaagaagcggtggaagatgagcggttctgggaccttgtgcacagagagagggagcttcacaaacagggaaaatgcgccacgtgtgtttacaacatgatggggaagagagagaaaaagctaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaactcggatacatactcagagacatatcaaagattcctgggggaaatatgtatgcagatgacacagccggatgggatacaaggataacagaggatgaccttcagaatgaggccaaaattactgacatcatggagcctgaacatgccctactggctacgtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctaataagacaaatggagtctgagggaatcttttcacccagcgagttggagaccccaaatttagccgagagagttctcgactggctggaaaaatatggcgtcgaaaggctaaaaagaatggcaatcagcggagatgactgcgtggtgaaaccaattgatgacaggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatggaagggaaatagtggtgccatgccgcaaccaagatgaacttgtgggtagggctagagtatcacaaggtgctggatggagcctgagagaaactgcatgcctaggcaagtcatatgcacaaatgtggcaactgatgtacttccacaggagagacctgagactagccgctaatgctatctgttcagccgttccagttgattgggtcccaaccagccgtaccacctggtcgatccatgcccatcaccaatggatgacaacagaagacatgttgtcagtgtggaatagggtttggatagaggaaaacccatggatggaggacaaaacccatatatccagctggggagatgttccatatttaggaaaaagggaagatcagtggtgtggatccctgataggcttaacagcaagggccacctgggccaccaacatacaagtggccataaaccaagtgagaagactaattgggaatgagaattatttagattacatgacatcaatgaagagattcaagaacgagagtgatcccgaaggggcactctggtga

SEQ ID NO: 5826 - RNA, 9879 nt, synthetic construct
  misc_feature 1..9879: note = derived and/or modified CDS sequence (wt) from DENV-1__GQ868606__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattgaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaaccacagaccaggatatttcacacaaacggcagggccgtggcacctaggcaagctggaactggattttgatttgtgtgagggtaccacagttgttgtggatgaacattgtggaaaccgaggaccatctctcaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctggctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattattatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaagaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggtgtcgaaaggctgaaaagaatggcaatcagcggagatgactgcgtagtgaaaccaattgatgataggtttgcaacagccttaacagccctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 5827 - RNA, 9879 nt, synthetic construct
  misc_feature 1..9879: note = derived and/or modified CDS sequence (wt) from DENV-1__FJ882539__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgctggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtggactcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgattacggagctcttacattggattgttcacctagaacaggactagactttaatgaaatggtgttgttgacaatgaaagaaaaatcatggctagtccacaaacaatggtttctagacctaccactgccttggacctcgggagctttagcatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggaataacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacatgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaaccacagaccaggatatttcacacaaacggcagggccgtggcacctaggcaagttggaactggattttgatttgtgtgagggtaccacagttgtcgtggatgaacattgtggaaatcgaggaccatctcttaggaccacaacagttacaggaaagataattcatgaatggtgctgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacattttccttgcactatgcatggaagacaatggccatggtactgtcaattgtatctctcttccccttatgcctgtctacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaaggggatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcggctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgctcagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctagttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctacgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcccgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggcctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaactctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtactttcacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 5828 - RNA, 9879 nt, synthetic construct
  misc_feature 1..9879: note = derived and/or modified CDS sequence (wt) from DENV-1__FJ882541__SS-prME
  source 1..9879: mol_type = other RNA
tctgtgaccatgctccttatgctgatacctacagccttggcattccatttgactacacgaggaggagagccgcacatgatagttagcaagcaggaaagaggaaagtcacttttgttcaagacctcagcaggtgttaacatgtgcaccctcatagcgatggatttgggagagttatgtgaggacacaatgacttacaaatgtcctcgaattactgaggtggaaccagatgacgttgattgttggtgcaataccacagacacatgggtgacctatggaacatgttcccaaactggcgagcaccgacgagacaagcgttccgtcgcactggccccacacgtgggacttggtttagaaacaagagccgaaacgtggatgtcctctgaaggcgcttggaaacagatacaaaaagtggagacttgggctctgagacacccaggattcacggtgatagccctttttctagcacatgccataggaacatccatcacccagaaagggattattttcattctgttaatgctggtgacaccttccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacattggtggaagaacaagacgcgaactttgtgtgccgacgaacgtttgtggacagaggctggggcaatggctgtgggctcttcggaaaaggaagtctgataacgtgtgctaagttcaagtgtgtgacaaaactggaaggaaagatagttcaatatgaaaatttgaaatattcagtaatagtcaccgtccacactggagaccagcaccaggtgggaaatgagagcacagaacatgggacaactgcaactataacacctcaagctcctacgtcggaaatacagctgaccgactacggagctcttacattggactgctcacctagaacaggactagactttaatgagatggtgttgttgacaatgaaaggaaaatcatggctagtccacaaacaatggtttctagacctaccattgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtccggaacgacaacaatttttgcaggacacctgaaatgtagactaaagatggacaaactgactctaaaagggatgtcatatgtgatgtgcacaggttcattcaagctagagaaagaagtggctgagacccagcatggaaccgttttagtgcagattaaatacgaaggaacagatgcaccatgcaagatccccttttcgacccaagatgaaaaaggagtaacccagaacgggagattgataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatattgggagacaccgcatgggactttggttctataggaggagtgttcacgtctgttggaaaactagtacaccagatttttggaactgcatatggagttttgttcagcggtgtttcctggaccatgaaaataggaataggggttctgctgacatggctaggattaaactcaaggagcacgtccctttcgatgacgtgcattgcagttggtctagtaacactatacctaggagtcatggttcaggcggattcaggatgtgtgattaattggaagggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccacccgtctcgagaatatcatgtggaggcaaatatcaaatgaactgaaccacatcttacttgaaaatgacatgaaattcacagtagttgtaggagatgttgttgggatcttggctcaaggaaaaaagatgattaggccacaacccatggaacacaaatactcgtggaaaagctggggaaaagctaaaatcataggggcagatgtacagaacaccaccttcatcatcgatggcccaaacaccccagaatgccctgatgatcaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgatatggggtactggatagaaagtgaaaagaatgagacctggaagctggcaagagcctcttttatagaagttaaaacatgtatctggccaaaatcccacaccctatggagcaatggagttctggaaagtgaaatgataattccaaaaatctatggaggaccaatatctcagcacaactacagaccaggatatttcacacaaacggcagggccgtggcacctaggcaagttggaactggattttgatttatgtgagggtaccacagttgttgtggatgaacattgtggaaatcgaggaccatctcttagaaccacaacagtcacaggaaagataattcatgaatggtgttgcagatcttgcacgctaccacccttacgtttcaaaggagaagatgggtgttggtacggtatggaaatcagaccagtcaaggaaaaggaagagaatctagtcaaatcaatggtctcagcagggtcaggggaagtggacagcttttcactaggactgttatgcatatcaataatgatcgaagaggtgatgagatccagatggagtagaaaaatgctgatgactggaacactggctgtgttcttccttctcataatgggacaattgacatggaatgatctgatcaggtcatgcatcatggttggagccaacgcttccgacaggatggggatgggaacgacgtacctagctttgatggccacttttaaaatgagaccaatgtttgctgtcgggctattattccgcagactaacatccagagaagttcttcttctaacaattggattgagtctagtggcatctgtggagttaccaaattccttggaagagctgggggatggacttgcaatgggcattatgattttaaaattattgactgactttcagtcatatcagctgtgggctaccttgctgtccttgacatttatcaaaacaacgttttccttgcactatgcatggaagacaatggctatggtactgtcaattgtatctctcctccccttatgcctgtccacgacctcccaaaaaacaacatggctcccggtgctattgggatctcttggatgcaaaccactaaccatgtttcttatagcagaaaacaaaatctggggaaggaaaagttggcccctcaatgaaggaatcatggctgttggcatagtcagcatcctactaagttcactcctcaaaaatgatgtgccgctagctgggccactaatagctggaggcatgctaatagcatgttatgttatatcaggaagctcagccgacctatcactagagaaagcggctgaggtttcttgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaggggaagagactggaaccgagttgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcaccttcaagacccctgaaggtgaagttggagccattgccttagatttcaaacccggcacatctggatctcctatcgtgaacagagaagggaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcgggaaaaacaagaagatatcttccagccatagtccgtgaggccataaaaaggaagctgcgcacactaattttggctcccacaagggttgtcgcttccgaaatggcagaggcgctcaaggggatgccaataaggtaccaaacaacagcagtgaagagtgaacacacaggaagagagatagttgatcttatgtgtcacgccactttcaccatgcgtctcctgtctcctgtgagagttcccaattacaacatgattatcatggatgaagcacatttcaccgatccatccagcatagcggccagaggatacatctcaacccgagtgggcatgggtgaagcagctgcgatcttcatgacagccactcccccaggatcggtggaagcctttccacagagcaatgcagtaatccaagatgaggaaagagacattcctgaaagatcatggaactcaggctatgagtggatcactgacttcccaggtaaaacagtttggtttgttccaagcatcaaatcaggaaatgacattgccaactgcctaagaaagaatgggaaacgggtgattcaattgagcaggaaaacctttgatacagagtaccaaaaaacaaaaaataacgactgggactacgtcgttacaacagacatctccgaaatgggagcaaacttccgggccgacagggtgatagacccaagacggtgtctgaaaccggtaatactaaaagatggtccagagcgtgtcatcttagcaggaccgatgccagtgactgtggccagtgccgcccagaggagaggaagaattggaaggaaccacaataaggaaggtgatcagtacatctacatgggacagcccttaaacaacgatgaagatcacgcccactggacagaagcaaaaatgctccttgataatataaacacaccagaagggattatcccagccctcttcgaaccggagagagaaaagagtgcagcaatagacggggaatacagactgcggggtgaagcaaggaaaacgtttgtggagctcatgagaagaggagatctacctgtctggttatcctacaaagttgcctcagaaggcttccagtactccgacagaagatggtgctttgacggggaaaggaacaaccaggtgttggaggagaacatggacgtggagatctggacaaaagaaggagaaagaaagaaactacgaccccgctggctagatgccagaacatactcagacccactggccctgcgcgagtttaaagagtttgcagcaggaagaagaagcgtctcaggtgatttaatattagagatagggaaacttccacaacacttgacgcaaagggcccagaatgccttggacaacctggtcatgttgcacaactccgaacaaggaggaagagcctatagacatgcaatggaagaactgccagacactatagaaacgttgatgctcctagctttgatagctgtgttgactggtggagtgacgctgttcttcctatcaggaaggggcctagggaaaacatctatcggcctactctgcgtgatggcttcaagcgcactgctatggatggccagtgtggagccccattggatagcggcctccatcatactggagttcttcttgatggtgctgcttattccagagccagacagacaacgcactccgcaagacaaccagctggcatatgtggtgataggtttgttattcatgatacttacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagccatattgatgggacttgacaaaggatggccaatatcgaagatggacataggagttccacttctagccttggggtgttattcccaagtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctaaccacgctttgggagggatctccaggaaaattctggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctacaaaaggagtgggataatggaagtggacagatccgaagccaaagagggactaagaagaggagaaacaaccaaacatgcagtgtcgagaggaaccgccaaactgaggtggtttgtggagaggaatcttgtgaaaccagaagggaaagtcatagacctcggttgtggaagaggtggctggtcatactattgcgctgggctgaagaaagtcacagaagtgaagggatacacaaaaggaggacccggacatgaggaaccaatcccaatggcgacctatggatggaacctagtaaagctgcactccgggaaagacgtattctttataccacctgagaaatgtgacacccttttgtgtgatattggtgaatcctctccaaacccaactatagaggaaggaagaacgttacgcgtcctaaagatggtggaaccatggctcagaggaaaccaattctgcataaagattctgaatccctacatgccaagtgtggtggaaaccctggaacaaatgcaaagaaaacatggaggaatgctagtgcgaaatccactttcaagaaattctacccatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaacaagacatgtggcagtggaaccagaggtagccaatctggatatcattggccagaggatagagaacataaaacatgaacacaagtcaacatggcattatgatgaggacaatccatataaaacatgggcctatcatggatcatatgaggtcaagccatcaggatcagcctcatccatggttaatggcgtggtgaaactgctcaccaaaccatgggatgtcatccctatggtcacacaaatagccatgactgacactacaccctttggacaacagagggtgtttaaagagaaagttgacacacgtacaccaaaagcaaaacggggcactgcacaaatcatggaggtgacagccaggtggttatggggttttctttccagaaacaaaaaaccaagaatttgtacaagagaggagttcacaagaaaagttaggtcaaacgcagccattggagcagtgttcgttgatgaaaatcaatggaactcagcaaaagaagcggtggaagatgaacggttctgggaccttgtgcacagagagagggagcttcacaaacagggaaaatgcgccacgtgtgtttacaacatgatggggaagagagagaaaaagctaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaactcggatacatactcagagacatatcaaagattcctgggggaaatatgtatgcagatgacacagccggatgggatacaaggataacagaggatgaccttcagaatgaggccaaaattactgacatcatggagcctgaacatgccctactggctacgtcaatcttcaagctgacctaccaaaataaggtggtaagggtacagagaccagcaagaaatggaaccgtgatggatgtcatatccagacgtgaccagagaggaagtggccaggtcggaacttatggcttaaacactttcaccaacatggaagcccagctaataagacaaatggagtctgagggaatcttttcacccagcgagttggagaccccaaatttagccgagagagttctcgactggctggaaaaacatggcgtcgaaaggctaaaaagaatggcaatcagcggagatgactgcgtggtgaaaccaattgatgacaggtttgcaacagccttatcagctctgaatgatatgggaaaagtaagaaaagatataccacaatgggaaccctcaaaaggatggaatgattggcaacaagtgcctttttgttcacaccacttccaccagctgattatgaaggatggaagggaaatagtggtgccatgccgcaaccaagatgaacttgtgggtagggctagagtatcacaaggtgctggatggagcctgagagaaactgcatgtctaggcaagtcatatgcacaaatgtggcaactgatgtacttccacaggagagacctgagactagccgctaatgctatctgttcagccgttccagttgattgggtcccaaccagccgtaccacctggtcgatccatgcccatcaccaatggatgacaacagaagacatgttgtcagtgtggaatagggtttggatagaggaaaacccatggatggaggacaaaacccatatatccagctggggagatgttccatatttaggaaaaagggaagatcagtggtgtggatccctgataggcttaacagcaagggccacctgggccaccaacatacaagtggccataaaccaagtgagaagactaattgggaatgagaattatttagattacatgacatcaatgaagagattcaagaacgagagtgatcccgaaggggcactctggtga

SEQ ID NO: 5829 - RNA, 9879 nt, synthetic construct
  misc_feature 1..9879: note = derived and/or modified CDS sequence (wt) from DENV-1__FJ882542__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactagccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggatagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaggatttgctggtgacattcaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttctgtaggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatctttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaagggaaaaaaatgattaggccacaacccatggaacacaaatactcgtggaaaagctggggaaaagctaaaatcataggggcagatgtacagaacaccaccttcatcatcgacggcccaagcaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttctcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggagatggacttgcaatgggcattatgattttaaaactattgactgactttcagtcacatcagctgtgggctaccttgctgtccttgacatttattaaaacaacgctttccttacactatgcatggaagacaatggctatggtattgtcaattgcatctctcttccccttatgcctgtccacgacctcccaaaaaacaacgtggcttccggtgctattgggatctcttggatgcaaaccactaaccatgtttcttataacagaaaccaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatattagtggtggtccaagatgatggaactatgaagataaaggatgaagagagagatgacacgctaaccattctccttaaagcaactctgctagcagtttcaggggtgtacccattatcaataccagcgaccctttttgtgtggtacttctggcagaaaaagaaacagagatctggagtgctatgggacacacctagccctccagaagtggaaagagcagttcttgatgatggcatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcttggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaagccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcctccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacgacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgtgagtttaaagagtttgcagcaggaagaagaagcgtctcaggtgatctaatattagaaatagggaagcttccacaacacttgacgcaaagggcccagaatgccctggacaacctggtcatgttgcacaactccgaacaaggaggaagagcctatagacatgcaatggaagaattgccagacaccatagaaacgttgatgctcctagctttgatagctgtgttgactggtggaatgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttgggatgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatattatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctttgggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattcttcacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatttgtacaagagaggagttcacaagaaaagtcaggtcaaacgcggccattggagcagtgttcgttgatgaaaatcaatggaactcagcaaaagaagcagtggaagatgagcggttctgggaccttgtgcaaaaagagagagagcttcacaaacagggaaaatgtgccacgtgtgtttacaacatgatggggaagagagagaaaaaactaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccaggaggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaatatggcgtcgaaaggctgaaaaggatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgctcagccgttccagttgattgggtcccaaccagtcgcaccacctggtcgatccatgcccaccaccaatggatgacaacagaagacatgttgtcagtgtggaatagggtttggatagaggaaaatccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 5830 - RNA, 9879 nt, synthetic construct
  misc_feature 1..9879: note = derived and/or modified CDS sequence (wt) from DENV-1__FJ882543__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcaatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccacaaacaatggtttctagacctaccactgccttggacctcaggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggccgagacccagcatggaaccgttttagtgcagattaaatacgaaggaacagatgcaccatgcaagatccctttttcgacccaagatgaaaaaggagtaacccagaatgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctattggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagggagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgttggagatgtagttgggatcttggctcaaggaaaaaaaatgattaggccacaacccatggaacacaaatactcgtggaaaagctggggaaaagctaaaatcataggggcagatgtgcagaacaccaccttcatcatcgacggcccaaacaccccagaatgccctgatgatcaaagagcatggaacatttgggaagttgaggactatggatttggaattttcacgacaaatatatggttgaaaatgcgtgactcctacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaaccacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtaggaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaagagctgggagatggacttgcaatgggcattatgattttaaaattattgactgactttcagtcacatcagctgtgggctgccttgctgtccttgacatttattaaaacaacgctttccttacactatgcatggaagacaatggctatggtactgtcaattgtatctctcatccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaattatggctgttggagtagtcagcatcctactaagttcacttctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatattggtggaggtccaagatgatggaactatgaagataaaggatgaagagagagatgacacgctaaccattctccttaaagcaactctgctagcagtttcaggggtgtacccattatcaataccagcgaccctttttgtgtggtacttctggcagaaaaagaaacagagatctggagtgctatgggacacacccagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccaggcaccttcaagacccctgaaggtgaagttggagccattgccctagattttaaacccggcacatccggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagtaatgcagttatccaagatgaggaaagagacattcctgagagatcatggaactcaggatatgagtggatcactgacttcctaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgttattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagccgtgttgactggtggagtgacgctgttcttcctatcaggaaggggcctagggaaaacatctatcggcttactctgcgtgatggcttcaagcgtactgctatggatggccagtgtggaaccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagccatattgatgggacttgacaaaggatggccaatatcgaagatggacataggagttccacttctcgccttgggatgctattcacaggtgaatccactgacgctgacagcggcggtattgatgctagtggctcactacgccataattggacctggattgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccattacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgacattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaaaagacgtggacctaggcgctggaactagacatgtggcagtggaaccagaagtagccaacctggatatcattggccagaggatagagaacataaaacatgagcacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagtgcaaatcatggaggtgacagccagatggttatggggttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgaaaaaagagagggagcttcacaaacagggaaaatgtgccacgtgtgtttacaacatgatggggaagcgagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaacatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaactgtgatggatgtcatatccagacgtgaccaaagaggaagtggccaggtcggaacttatggcttgaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttgggaagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 5831 - RNA, 9879 nt, synthetic construct
  misc_feature 1..9879: note = derived and/or modified CDS sequence (wt) from DENV-1__FJ882544__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagctctttttctagcacatgccataggaacatccatcacccagaaagggattattttcattttgttaatgctggtaacaccatccatggccatgcgatgcgtgggaataggcaacagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaaggaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattagatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggagcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacaccctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtgggaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttattattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataagaggagtggaattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcaacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaacattccagggggaaacatgtatgcagatgacacagccggatgggatacaaggataacagaggatgaccttcagaatgaggccagaattactgacatcatggaacctgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5832 - RNA, 9879 nt, synthetic construct
  misc_feature 1..9879: note = derived and/or modified CDS sequence (wt) from DENV-1__FJ898371__SS-prME
  source 1..9879: mol_type = other RNA
tctgtgactatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgactaaactggaaggaaagatagttcaatatgaaaacttgaaatattcagtaatagtcaccgtccacactggagaccagcaccaggtgggaaatgaaagcacagaacatgggacaactgcaactataacaccccaagctcccacgtcggaaatacagctgaccgactacggagctctcacattggattgctcacccagaacaggactagactttaatgaaatggtgttgttgacaatgaaagaaaaatcatggctagtccataaacaatggtttctagacctaccattgccttggacctcaggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatcccttttttgacccaagatgaaaaaggagtaacccagaatgggagattgataacagctaatcctatagtcactgacaaagaaaaaccagtcaacattgaggcagaaccgccttttggtgagagttacatcgtgataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtacaccagatttttggaaccgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaagggaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcccacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaacggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggggatggacttgcaatgggcattatgattttaaaattattgactgactttcagtcacatcagctgtgggccaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaattatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcacacaatatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtacttatgtaccaagggaagagactagaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccaggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggatcatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggctttcagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgctgactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttaatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggggaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctgggcatgaggaaccaatcccaatggcgacctatggatggaacctagtaaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccttacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgttaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtagtgaaactgctcaccaaaccatgggatgtcatccccatggtcacacaaatagctatgactgacactacaccctttggacaacagagggtgttcaaagagaaagttgacacgcgcacaccaaaagcaaaacgaggcacagcacaaatcatggaggtgacagccagatggttatggggttttctttctagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagacccaaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggagaacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 5833 - RNA, 9879 nt, synthetic construct
  misc_feature 1..9879: note = derived and/or modified CDS sequence (wt) from DENV-1__FJ882545__SS-prME
  source 1..9879: mol_type = other RNA
tctgtgaccatgctccttatgctgatgcctacagccttggcgttccatttgaccacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagtttaagtgtgtgacaaaactggaaggaaagatagtccaatatgaaaacttgaaatactcagtaatagtcaccgtccacactggagaccagcaccaggtgggaaatgaaagcacagaacatgggacaactgcaaccataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaggtggctgagacccagcatggaaccgttctagtgcagattaaatacgaaggaacagatgcaccatgcaagatccccttttcgacccaagatgagaaaggagtaacccagaatgggagattgataacagccaaccccatagtcactgacaaagaaaaaccagtcaacattgaggcagaaccgccttttggtgagagttacatcgtgataggagcaggtgaaaaagctttgaagctaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagtcggcctagtaacgctatacttaggagtcatggttcaggcagattcaggatgtgtaattaactggaaaggtagagaactcaaatgtggaagtggcatttttgttaccaatgaagttcatacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaactcacagtggttgtaggagatgttgctgggatcttgggccaagggaagaaaatgattaggccacaacccatggaatataaatactcgtggaaaagctggggaaaggctaaaatcataggggcagatgcacagaacaccaccttcatcatcgacggcccaaacaccccggaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcctccgacaggatggggatgggaacgacgtatctagctctgatggccacttttaaaatgagaccaatgtttgctgtggggctgctattccgcagactaacatccagagaagttcttcttctaacaattggattgagtctagtggcatctgtggagttaccaaattccttggaggagctgggggatggacttgcaatgggcattatgattttaaaattgttgactgactttcaatcacatcagctgtgggctaccttgctgtccttgacatttatcaaaacaacattttctttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatttggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatactagtggaggtccaagatgatggaaccatgaagataaaggatgaagagagagatgacacgctaaccattctccttaaagcaactctgctagcagtttcaggggtgtacccattatcaataccagcaaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcgaggatcctggaacacgggagaagaagtgcaggtgattgctgttgaaccagggaaaaaccccaaaaatgtacaaacggcgccgggcacctttaagacccctgaaggcgaagttggagccattgctctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacattttacagatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcaccgacttcccaggcaaaacagtttggtttgttccaagcattaaatcaggaaatgacattgccaactgcttaagaaagaatgggaagcgggtgattcaattgagcaggaaaacctttgacacagagtaccaaaaaacaaaaaataacgactgggactacgttgtcacaacagacatctccgaaatgggagcgaatttccgggccgacagggtgatagacccaagacggtgtctgaaaccggtaatactaaaggatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcagtagacggggaatacagactgcgaggtgaagcaaggaaaacgtttgtggagctcatgagaagaggagatctacctgtctggctatcctacaaagttgcttcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaataggaaaacttccacaacacttgacgcaaagggcccagaatgccttggacaacctggttatgctgcacaattccgaacaaggaggaagagcctatagacatgcaatggaagaactgccagacaccatagaaacgttaatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacagcaaacatttccctgacagccattgcaaaccaggcagctatattgatgggacttgacaaaggatggccaatatcgaagatggacataggggttccacttctcgctttggggtgctattcccaggtgaatccactgacgctgacagcggcggtattgatgctagtggcccattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatttagcaggagcaggtctggccttctcattaatgaaatctctaggaggaggtaggagaggcacaggagcccaaggggaaacactgggagagaaatggaaaagacagctgaaccaactgagcaagtcagaattcaacacctataaaaggagtgggattatggaagtggacagatctgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaggtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcatctccaaacccaactatagaggaaggaagaacgctacgcgtcctaaagatggtggaaccatggctcagaggaaaccaattctgcataaaaattctgaatccctacatgccaagtgtggtggaaactctggagcaaatgcaaagaaaacatggaggaatgctagtgcgaaatccactttcaagaaattctacccatgaaatgtattgggtttcatgtggaacaggaaacattgtgtcagcagtaaacatgacatccagaatgttgctaaatcgattcacaatggctcacaggaaaccaacatatgaaagagacgtggacctaggcaccggaacaagacatgtggcagtggaaccagaggtagccaacctagatattattggccagaggatagagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttgggcaacagagggtgtttaaagagaaagttgacacacgcacaccaaaagcaaaacgaggcacagcacaaatcatggaggtgacagccaggtggttatggggttttctttctagaaacaagaaaccaagaatttgtacaagagaggagttcacaagaaaagttaggtcaaacgcagccatcggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagtttggaaaggcaaaaggaagtcgtgcaatatggtacatgtggttgggagcacgttttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgttatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagctctcgattggctgggaaaatatggcgtcgaaaggctaaaaagaatggcaatcagtggagatgattgcgtagtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacaggagagacctaagactagccgctaatgctatctgttcagccgttccagttgattgggtcccaactagccgcaccacctggtcgatccatgcccatcaccaatggatgacaacagaagacatgctgtcagtgtggaatagggtttggatagaggaaaacccatggatggaggacaaaacccacatatccagctgggaagatgttccatatttagggaaaagggaagatcaatggtgtggatccctgataggcttaacagcaagggccacctgggccaccaacatacaagtggctataaaccaagtgagaagactaattgggaatgagaattatctagattacatgacatcaatgaagagattcaagaacgagagtgatcccgaaggggcactctggtga

SEQ ID NO: 5834 - RNA, 9879 nt, synthetic construct
  misc_feature 1..9879: note = derived and/or modified CDS sequence (wt) from DENV-1__FJ898372__SS-prME
  source 1..9879: mol_type = other RNA
tctgtgaccatgctccttatgctgatgcctacagccttggcgttccatttgaccacacgagggggagagccgcacatgatagtcagcaagcaggaaagaggaaagtcacttttgtttaagacctcagcaggtgtcaacatgtgcaccctgatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtactggaacatggaagttgcgtcactaccatggcaagagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggttggggcaatggctgtgggctcttcggaaaaggaagcctaataacgtgtgctaagtttaagtgtgtgacaaaactggaaggaaagatagtccaatatgaaaacttgaaatactcagtaatagtcaccgtccacactggagaccagcatcaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaggtggctgagacccagcatggaaccgttctagtgcagattaaatacgaaggaacagatgcaccatgcaagatccctttttcgacccaagatgagaaaggagtaacccagaatgggagattgataacagccaaccccatagtcactgacaaagaaaaaccagtcaacattgaggcagaaccgccttttggtgagagttacatcgtgataggagcaggtgaaaaagctttgaagctaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagtcggcctagtaacgctatacttaggagtcatggttcaggcagattcaggatgtgtaattaactggaaaggtagagaactcaaatgtggaagtggcatttttgttaccaatgaagttcatacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaactcacagtggttgtaggagatgttgctgggatcttgggccaagggaagaaaatgattaggccacaacccatggaatataaatactcgtggaaaagctggggaaaggctaaaatcataggggcagatgcacagaacaccaccttcatcatcgacggcccaaacaccccggaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcctccgacaggatggggatgggaacgacgtatctagctctgatggccacttttaaaatgagaccaatgtttgctgtggggctgctattccgcagactaacatccagagaagttcttcttctaacaattggattgagtctagtggcatctgtggagttaccaaattccttggaggagctgggggatggacttgcaatgggcattatgattttaaaattgttgactgactttcaatcacatcagctgtgggctaccttgctgtccttgacatttatcaaaacaacattttctttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatttggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatactagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcgaggatcctggaacacgggagaagaagtgcaggtgattgctgttgaaccagggaaaaaccccaaaaatgtacaaacggcgccgggcacctttaagacccctgaaggcgaagttggagccattgctctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtcccccgtgagagttcccaattacaacatgattatcatggatgaagcacattttacagatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcaccgacttcccaggcaaaacagtttggtttgttccaagcattaaatcaggaaatgacattgccaactgcttaagaaagaatgggaagcgggtgattcaattgagcaggaaaacctttgacacagagtaccaaaaaacaaaaaataacgactgggactacgttgtcacaacagacatctccgaaatgggagcgaatttccgggccgacagggtgatagacccaagacggtgtctgaaaccggtaatactaaaggatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgacaatataaacacaccagaagggattatcccagccctcttcgagccggagagagaaaagagtgcagcagtagacggggaatacagactgcgaggtgaagcaaggaaaacgtttgtggagctcatgagaagaggagatctacctgtctggctatcctacaaagttgcttcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaataggaaaacttccacaacacttgacgcaaagggcccagaatgccttggacaacctggttatgctgcacaattccgaacaaggaggaagagcctatagacatgcaatggaagaactgccagacaccatagaaacgttaatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacagcaaacatttccctgacagccattgcaaaccaggcagctatattgatgggacttgacaaaggatggccaatatcgaagatggacataggggttccacttctcgctttggggtgctattcccaggtgaatccactgacgctgacagcggcggtattgatgctagtggcccattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatttagcaggagcaggtctggccttctcattaatgaaatctctaggaggaggtaggagaggcacaggagcccaaggggaaacactgggagagaaatggaaaagacagctgaaccaactgagcaagtcagaattcaacacctataaaaggagtgggattatggaagtggacagatctgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaggtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcatctccaaacccaactatagaggaaggaagaacgctacgcgtcctaaagatggtggaaccatggctcagaggaaaccaattctgcataaaaattctgaatccctacatgccaagtgtggtggaaactctggagcaaatgcaaagaaaacatggaggaatgctagtgcgaaatccactttcaagaaattctacccatgaaatgtattgggtttcatgtggaacaggaaacattgtgtcagcagtaaacatgacatccagaatgttgctaaatcgattcacaatggctcacaggaaaccaacatatgaaagagacgtggacctaggcaccggaacaagacatgtggcagtggaaccagaggtagccaacctagatattattggccagaggatagagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttgggcaacagagggtgtttaaagagaaagttgacacacgcacaccaaaagcaaaacgaggtacagcacaaatcatggaggtgacagccaggtggttatggggttttctttctagaaacaagaaaccaagaatttgtacaagagaggagttcacaagaaaagttaggtcaaacgcagccatcggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagtttggaaaggcaaaaggaagtcgtgcaatatggtacatgtggttgggagcacgttttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgttatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagctctcgattggctggaaaaatatggcgtcgaaaggctaaaaagaatggcaatcagtggagatgattgcgtagtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacaggagagacctaagactagccgctaatgctatctgttcagccgttccagttgattgggtcccaactagccgcaccacctggtcgatccatgcccatcaccaatggatgacaacagaagacatgctgtcagtgtggaatagggtttggatagaggaaaacccatggatggaggacaaaacccatatatccagctgggaagatgttccatatttagggaaaagggaagatcaatggtgtggatccctgataggcttaacagcaagggccacctgggccaccaacatacaagtggctataaaccaagtgagaagactaattgggaatgagaattatctagattacatgacatcaatgaagagattcaagaacgagagtgatcccgaaggggcactctggtga

SEQ ID NO: 5835 - RNA, 9879 nt, synthetic construct
  misc_feature 1..9879: note = derived and/or modified CDS sequence (wt) from DENV-1__FJ898373__SS-prME
  source 1..9879: mol_type = other RNA
tctgtgaccatgctccttatgctgatgcctacagccttggcattccatttgactacacgaggaggagagccgcacatgatagttagcaagcaggaaagaggaaagtcacttttgttcaaaacctcagcaggtgtcaacatgtgcaccctcatagcgatggatttgggagagttatgtgaggacacaatgacttacaaatgtcctcgaattactgaggtggaaccagatgacgttgattgttggtgcaacaccacagacacatgggtgacctatggaacatgttcccaaactggcgagcaccgacgagacaagcgttccgtcgcactggccccacacgtgggacttggtttagaaacaagagccgaaacgtggatgtcctctgaaggcgcttggaaacagatacaaaaagtggagacttgggccctgagacacccaggattcacggtaatagccctttttctagcacatgccataggaacatccatcacccagaaagggattattttcattctgttaatgctggtaacaccttccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacattggtggaagaacaagacgcgaactttgtgtgccgacgaacgtttgtggacagaggctggggcaatggctgtgggctcttcggaaaaggaagcctgataacgtgtgctaagttcaagtgtgtgacaaaactggaaggaaagatagttcaatatgaaaatttgaaatattcagtaatagtcaccgtccacactggagaccagcaccaggtgggaaatgaaagcacagaacatgggacaattgcaactataacacctcaagctcctacgtcggaaatacagctgaccgactacggagctcttacattggactgctcacctagaacaggactggactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgaccggaacgacaacaatttttgcaggacacctgaaatgtagactaaagatggacaaactgactctaaaagggatgtcatatgtgatgtgcacaggttcattcaagctagagaaagaagtggctgagacccagcatggaaccgttctagtgcagattaaatacgaaggaacagatgcaccatgcaagatccctttttcgacccaagatgaaaaaggagtaacccagaacgggagattgataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaactagtacaccagatttttggaactgcatatggagttttgttcagcggtgtttcctggaccatgaaaataggaataggggttctgctgacatggctaggattaaactcaaggagcacgtccctttcgatgacgtgcattgcagttggtctaataacactatacctaggagtcatggttcaggcggattcaggatgtgtaattaattggaagggtagagaactcaaatgtggaagtggcatttttgtcaccaatgaagtccacacttggacagagcaatacaaatttcaagctgactccccaaagagactatcagcagccgtcgggaaggcatgggaggagggtgtgtgtggaattcgatcagccacccgtctcgagaatatcatgtggaggcaaatatcaaatgaactgaaccacatcttacttgaaaatgacatgaaattcacagtagttgtaggagatgttgttgggatcttggctcaaggaaaaaagatggttaggccacaacccatggaacacaaatactcgtggaaaagctggggaaaagccaaaatcataggggcagatgtacagaacaccaccttcatcatcgatggcccaaacaccccagaatgccctgatgatcaaagagcatggaacatttgggaagttgaggactatggatttggaattttcacgacaaacatatggctgaaattacgtgactcctacacccaagtatgtgaccaccggctaatgtcagctgccatcaaggacagcaaggcagttcacgctgatatggggtactggatagaaagtgaaaagaatgagacctggaagttggcaagagcctcttttatagaagttaaaacatgtatctggccaaaatcccacaccctatggagcaatggagttctggaaagtgaaatgataattccaaaaatctatggaggaccaatatctcagcacaactacagaccaggatatttcacacaaacggcaggcccgtggcacctaggcaagttggaactggattttgatttatgtgagggtaccacagttgttgtggatgaacattgtggaaatcgaggaccatctcttagaaccacaacagtcacaggaaagataattcatgaatggtgttgcagatcttgcacgctaccacccttacgtttcaaaggagaagatggatgttggtacggtatggaaatcagaccagtcaaggaaaaggaagagaatctagtcaaatcaatggtctcagcagggtcaggggaagtggacagcttttcactaggactgttatgcatatcaataatgatcgaagaggtgatgagatccagatggagtagaaaaatgctgatgactggaacattggctgtgttcttccttctcataatgggacaattgacatggaatgatctgatcaggtcatgcatcatggttggagccaacgcttccgacaggatggggatgggaacgacgtacctagctttgatggccacttttaaaatgagaccaatgtttgctgtcgggctattattccgcagactaacatccagagaagttcttcttctaacaattggattgagtctagtggcatctgtggagttaccaaattccttggaggagctgggggatggacttgcaatgggcattatgattttaaaattattgactgactttcagtcatatcagctgtgggctaccttgctgtccttgacatttatcaaaacaacgttttccttgcactatgcatggaagacaatggctatggtactgtcaattgtatctctcctccccttatgcctgtccacgacctcccaaaaaacaacgtggctcccggtgctattgggatctcttggatgcaaaccactaaccatgtttcttatagcagaaaacaaaatctggggaaggaaaagttggcccctcaatgaaggaatcatggctgttggcatagtcagcatcctactaagttcactcctcaaaaatgatgtgccgctagctgggccactaatagctggaggcatgctaatagcatgttatgttatatcaggaagctcagccgacctatcactagagaaagcggctgaggtctcttgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcactttcaagacccctgaaggtgaagttggagccattgccttagatttcaaacccggcacatctggatctcctatcgtgaacagagaagggaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcgggaaaaacaagaagatatcttccagccatagtccgtgaggccataaaaaggaagctgcgcacactaattttggctcccacaagggttgtcgcttccgaaatggcagaggcgctcaaggggatgccaataaggtaccaaacaacagcagtgaagagtgaacacacaggaagagagatagttgatcttatgtgtcacgccactttcaccatgcgtctcctgtctcctgtgagagttcccaattacaacatgattatcatggatgaagcacatttcaccgatccatccagcatagcggccagaggatacatctcaacccgagtgggcatgggtgaagcagctgcgatcttcatgacagccactcccccaggatcggtggaagcctttccacagagcaatgcagttatccaagatgaggaaagagacattcctgaaagatcatggaactcaggctatgagtggatcactgacttcccaggtaaaacagtttggtttgttccaagcatcaaatcaggaaatgacattgccaactgcctaagaaagaatgggaaacgggtgattcaattgagcaggaaaacctttgatacagagtaccaaaaaacaaaaaataacgactgggactacgtcgttacaacagacatctccgaaatgggagcaaacttccgggccgacagggtgatagacccaagacggtgtctgaaaccggtaatactaaaagatggtccagagcgtgtcatcttagcaggaccgatgccagtgactgtggccagtgccgcccagaggagaggaagaattggaaggaaccacaataaggaaggtgatcagtacatctacatgggacagcctttaaacaacgatgaagatcacgcccactggacagaagcaaaaatgctccttgataatataaacacaccagaagggatcatcccagccctcttcgaaccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactccgacagaagatggtgctttgacggggaaaggaacaaccaggtgttggaggagaacatggacgtggagatctggacaaaagaaggagaaaggaaaaaactacgaccccgctggctagatgccagaacatactcagacccactggccctgcgcgagtttaaagagtttgcagcaggaagaagaagcgtctcaggtgatttaatattagaaatagggaaacttccacaacacttgacgcaaagggcccagaatgccttggacaacctggtcatgttgcacaactccgaacaaggaggaagagcctatagacatgcaatggaagaactgccagacactatagaaacgttgatgctcctagctttgatagctgtgttgactggtggagtgacgctgttcttcctatcaggaaggggcctagggaaaacatctatcggcctactctgcgtgatggcttcaagcgcactgctatggatggccagtgtggagccccattggatagcggcctccatcatactggagttcttcttgatggtgctgcttattccagagccagacagacaacgcactccgcaagacaaccagctggcatatgtggtgataggtttgttattcatgatacttacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctagccttggggtgctattcccaagtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccccgtggtttatgatgcaaaatttgagaaacaattaggccaaataatgttgttgatactatgcacatcacagatccttttgatgcggactacatgggccttgtgcgaatccatcacactggccactggacctctgaccacgctttgggagggatctccaggaaaattctggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctacaaaaggagtgggataatggaagtggacagatccgaagccaaagagggactaagaagaggagaaacaaccaaacatgcagtgtcgagaggaaccgccaaactgaggtggtttgtggagaggaatcttgtgaaaccagaagggaaagtcatagacctcggttgtggaagaggtggctggtcatactattgcgctgggctgaagaaagtcacagaagtgaagggatacacaaaaggaggacccggacatgaggaaccaatcccaatggcgacctatggatggaacctagtaaagctgcactccgggaaagacgtattctttataccacctgagaaatgtgacacccttttgtgtgatattggtgaatcctctccaaacccaactatagaagaaggaagaacgttacgcgtcctaaagatggtggaaccatggctcagaggaaaccaattctgcataaagattctgaatccctacatgccaagtgtggtggaaaccctggaacatatgcaaagaaaacatggaggaatgctagtgcgaaatccactttcaagaaattctacccatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaacaagacatgtggcagtggaaccagaggtagccaacctggatatcattggccagaggatagagaacataaaacatgaacacaagtcaacatggcattatgatgaggacaatccatataaaacatgggcctatcatggatcatatgaggtcaagccatcaggatcagcctcatccatggttaatggcgtggtgaaactgctcaccaaaccatgggatgtcatccctatggtcacacaaatagccatgactgacaccacaccctttggacaacagagggtgtttaaagagaaagttgacacacgcacaccaaaagcaaaacgaggcactgcacaaatcatggaggtgacagccaggtggttatggggctttctttccagaaacaaaaaaccaagaatttgtacaagagaggagttcacaagaaaagttaggtcaaacgcagccattggagcagtgttcgttgatgaaaatcaatggaactcagcaaaagaagcggtggaagatgagcggttctgggaccttgtgcacagagagagggagcttcacaaacagggaaaatgcgccacgtgtgtttacaacatgatggggaagagagagaaaaagctaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaactcggatacatactcagagacatatcaaagattcctgggggaaatatgtatgcagatgacacagccggatgggatacaaggataacagaggatgaccttcagaatgaggccaaaattactgacatcatggagcctgaacatgccctactggctacgtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctaataagacaaatggagtctgagggaatcttttcacccagcgagttggagaccccaaatttagccgagagagttctcgactggctggaaaaatatggcgtcgaaaggctaaaaagaatggcaatcagcggagatgactgcgtggtgaaaccaattgatgacaggtttgcaacagccttaacagctctgaatgatatgggaaaagtgagaaaagatataccacaatgggaaccctcaaaaggatggaatgattggcaacaagtgcctttttgttcacaccacttccaccagctgattatgaaggatggaagggaaatagtggtgccatgccgcaaccaagatgaacttgtgggtagggctagagtatcacaaggtgctggatggagcctgagagaaactgcatgcctaggcaagtcatatgcacaaatgtggcaactgatgtacttccacaggagagacctgagactagccgctaatgctatctgttcagccgttccagttgattgggtcccaaccagccgtaccacctggtcgatccatgcccatcaccaatggatgacaacagaagacatgttgtcagtgtggaatagggtttggatagaggaaaacccatggatggaggacaaaacccatatatccagctggggagatgttccatatttaggaaaaagggaagatcagtggtgtggatccctgataggcttaacagcaagggccacctgggccaccaacatacaagtggccataaaccaagtgagaagactaattgggaatgagaattatttagattacatgacatcaatgaagagattcaagaacgagagtgatcccgaaggggcactctggtga

SEQ ID NO: 5836 - RNA, 9879 nt, synthetic construct
  misc_feature 1..9879: note = derived and/or modified CDS sequence (wt) from DENV-1__FJ898374__SS-prME
  source 1..9879: mol_type = other RNA
tctgtgaccatgctgctcatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgtagattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacaccgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaatccagaatgggagattgataacagcaaatcctatagtcactgacaaagaaaaaccagtcaacattgaggcagaaccgccttttggtgagagttacatcgtgataggagtaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtgcaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagtcactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaacacaaccttcatcatcgacggcccaaacaccccagaatgccctgatgatcaaagagcatggaacatttgggaagttgaggactatggatttggaattttcacgacaaatatatggttgaaattgcgtgactcctacactcaagcgtgtgaccaccggttaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggagagtgaaatggtaattccaaaaatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgtagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgttgatgactggaacattggctgtgttcctccttctcataatggggcaattgacatggaatgatctgatcagattatgcattatggttggagccaacgcttccgacaggatggggatgggaacgacgtacctagctctgatggccacttttaagatgagaccaatgtttgctgtcgggctattattccgtagactaacatccagagaagttctccttcttacaattggattgagtctagtggcatctgtggagttaccaaattccttggaagagctgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaacgatgtgccgctagctgggccactaatagctggaggcatgctaatagcatgttatgttatatctggaagctcagctgacttatcactagagaaagcggctgaggtctcctgggaagaagaagcagaacactctggtgcctcgcacaatatattagtggaggtccaagatgatggaactatgaagataaaggatgaagagagagatgacacgctaaccattcttcttaaagcaactctgctagcagtttcaggggtgtatccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccagaggagctgtactcatgtatcaagggaagagactggaaccgagttgggccagtgtcaaaaaagacctgatctcatatggaggaggttggaggcttcaaggatcctggaacacgggagaggaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaaggtcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaactcgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgacaatataaacacaccagaagggattatcccagccctcttcgagccagagagggaaaagagtgcagcaatagacggggaatacagactgcggggtgaagcaaggaagacgtttgtggagctcatgagaagaggagatctacctgtttggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgctttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggatgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactgcaagcaaaggctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctaaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacacttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacttggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaagaaaccaagaatttgtacaagagaggagttcacaaggaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattaccgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaacatggcgtcgaaaggctgaaaagaatggcaatcagcggggatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtgtccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaatgagggtgatcccgaaggggcactctggtga

SEQ ID NO: 5837 - RNA, 9879 nt, synthetic construct
  misc_feature 1..9879: note = derived and/or modified CDS sequence (wt) from DENV-1__FJ898375__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatggccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagataaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcatttaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggtcgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctatacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtctcacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggggccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaacaaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcccacaaagttgcctcagaaggctttcagtactctgacagaagatggtgctttgatggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtctattattcatgatactgacagtagcagccaatgagatgggactgctggaaaccacaaagaaagacttagggattggccatgtggctgttgaaaagcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaagaacagcggccggaataatgaaaaatccaaccgttgatggaattgttgcaatagatttggatcccgtggtttatgatgcaaaatttgagaaacaactaggccaaataatgttgttaatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctatatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtacacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagatatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 5838 - RNA, 9879 nt, synthetic construct
  misc_feature 1..9879: note = derived and/or modified CDS sequence (wt) from DENV-1__FJ898376__SS-prME
  source 1..9879: mol_type = other RNA
tctgtgactatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgtcataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgttctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgactaaactggaaggaaagatagttcaatatgaaaacttgaaatattcagtaatagtcaccgtccacactggagaccagcaccaggtgggaaatgaaagcacagaacatgggacaactgcaactataacaccccaagctcccacgtcggaaatacagctgaccgactacggagctctcacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagacttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagattgataacagctaatcctatagtcactgacaaagaaaaaccagtcaacattgaggcagaaccgccttttggtgagagttacatcgtgataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtacaccagatctttggaaccgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaggttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaatttacagtggttgtaggagatgtagttgggatcttggctcaagggaaaaaaatgatcaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcccacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaacggagttctggaaagtgaaatgataattccaaagatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcgatggtctctgcagggtcaggggaagtggacagcttttcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactagccatgtttcttatagcagaaaacaaaatctggggaaggaaaagttggcccctcaatgaaggaattatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcacacaacatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtacttatgtaccaagggaagagactagaaccgagttgggccagtgtcaaaaaagacctgatctcatatggaggaggttggaggcttcaaggatcttggaacacgggagaagaagtgcaggtgattgctgttgaaccaggaaaaaaccccaaaaatgtacaaacagcgccaggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcagaaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgcgtcattctagcaggaccgatgccagtaactgtagccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggatcatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagtgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgctgactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacagctaggccaaataatgttgttaatactatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggggaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccttacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttactaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtagtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttctagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagatatatcaaagattccagggggaaatatgtatgcagatgacacagccggatgggatacaaggataacagaggatgatcttcagaatgaggccaaaattactgacatcatggagcccgaacatgccctactggctacgtcaatctttaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgaaggaatctttttacccagcgaattggagacccaaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctaactgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcttccaacatacaagtggccataaaccaagtgagaagactaattgggaatgagaattatctagattacatgacatcaatgaagagattcaagaacgagggtgatcccgaaggggcactctggtga

SEQ ID NO: 5839 - RNA, 9879 nt, synthetic construct
  misc_feature 1..9879: note = derived and/or modified CDS sequence (wt) from DENV-1__FJ898379__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaaatcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgtcataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaagtgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagttactgacaaagaaaaaccagtcaacattgaggcagaaccgccctttggtgagagttacatcataataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcttggaccatgaaaataggaataggggttctgctgacatggctgggattaaactcaaggagcacgtccctttcgatgacgtgcattgcagttggcctagtaacactatacctaggagtcatggttcaggcggattcaggatgtgtaatcaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctagaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcaactgtgggctaccttgctgtccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagctggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatccggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaataacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagcgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggtgaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctctgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccggagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacttagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgttgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactttggtga

SEQ ID NO: 5840 - RNA, 9879 nt, synthetic construct
  misc_feature 1..9879: note = derived and/or modified CDS sequence (wt) from DENV-1__GQ199773__SS-prME
  source 1..9879: mol_type = other RNA
tctgtgaccatgcttcttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgctggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagataaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaacagtcaccgtccacactggagaccagcaccaggtgggaaatgaaagcacagaacatgggacaactgcaactataacacctcaagctccttcgacggaaatacagctgaccgattacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcatactgcgttgaccggagcaacagaaatccaaacgtctggaacgacaacaatttttgcaggacacttgaaatgtagactaaagatggacaagctgactctaaaagggatgtcatatgtaatgtgcacaggctcatttaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacatgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgtcgtggatgaacattgtggaaatcgaggaccatctcttaggaccacaacagttacaggaaagataattcatgaatggtgctgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacattttccttgcactatgcatggaagacaatggccatggtactgtcaattgtatctctcttccctttatgcctgtctacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaaggggatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcggctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgctcagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctagttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctacgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcccgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaactctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctggaaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgacctccagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcctgaaggggcactctggtga

SEQ ID NO: 5841 - RNA, 9879 nt, synthetic construct
  misc_feature 1..9879: note = derived and/or modified CDS sequence (wt) from DENV-1__JF937596__SS-prME
  source 1..9879: mol_type = other RNA
tctgtgaccatgctacttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacatttaaaacagctcatgcaaagaagcaggaagtagtcgtactaggatcacaagaaggagcaatgcacaccgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaatccagaatgggagattgataacagcaaatcctatagtcactgacaaagaaaaaccagtcaacattgaggcagaaccgccttttggtgagagttacatcgtgataggagtaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtgcaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaacacaaccttcatcatcgacggcccaaacaccccagaatgccctgatgatcaaagagcatggaacatttgggaagttgaggactatggatttggaattttcacgacaaatatatggttgaaattgcgtgactcctacactcaagcgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatggtaattccaaaaatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgtagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgttgatgactggaacattggctgtgttcctccttctcataatggggcaattgacatggaatgatctgatcagattatgcattatggttggagccaacgcttccgacaggatggggatgggaacgacgtacctagctctgatggccacttttaagatgagaccaatgtttgctgtcgggctattattccgtagactaacatccagagaagttctccttcttacaattggattgagtctagtggcatctgtggagttgccaaattccttggaagagctgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatattagtggaggtccaagatgatggaactatgaagataaaggatgaagagagagatgacacgctaaccattcttcttaaagcaactctgctagcagtttcaggggtgtatccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggagtaggagtctttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaatagagaaggaaaaatagtaggtctttatggaaatggagtggtgacaacaagtggaacctacgtcagtgccatagctcaaaccaaagcatcacaagaaggtcccctaccagagattgaagatgaggtgtttaggaaaagaaacttaacaataatggacctacatccaggatcggggaaaacaagaagatacctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctactgtctcctgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggacatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgcctgaaaccggtaatactaaaagatggtccagagcgtgtcattctagcaggaccgatgccagtaactgtggccagtgccgcccagaggagaggaagaattggaaggaaccacaataaggaaggtgatcagtacatttacatgggacagcctttaaacaacgacgaagatcacgctcactggacagaagcaaaaatgctccttgacaatataaacacaccagaagggattatcccagccctcttcgagccagagagggaaaagagtgcagcaatagacggggaatacagactgcggggtgaagcaaggaagacgtttgtggagctcatgagaagaggagatctacccgtttggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgctttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtggacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctaaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaactgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttgcaccacctgagaaatgtgacacacttttgtgtgatattggtgagtcctctccaaacccaaccatagaagaaggaagaacgttacgcgtcctaaaaatggtggaaccatggctcagagggaaccaattctgcataaaaattctaaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacttggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggttacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaagaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaacatggcgtcgaaaggctgaaaagaatggcaatcagcggggatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagagaaatagtggtgccatgccgtaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtgtccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 5842 - RNA, 9879 nt, synthetic construct
  misc_feature 1..9879: note = derived and/or modified CDS sequence (wt) from DENV-1__FJ898380__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttgtgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgcaaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacccagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggttcaggcggattcaggatgtgtaattaattggaaaggtagagaactcaagtgtggaagtggcatttttgtcaccaatgaagttcacacttggacagagcaatacaaatttcaagctgactcccctaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctcattcatagaagttaaaacatgtatctggccaaaatcccacactctatggagcaatggagttctggaaagtgaaatgataattccaaagatctatggaggaccaatatctcagcacaactacagaccaggatattttacacaagcagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcaaaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaagaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgttcgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtaaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaatcctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgctgctcagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcttagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggttcgtggagaggaaccttgtgaaaccagaagggaaagtcatagacctcggttgtggaagaggtggctggtcatactattgcgctgggctgaagaaagtcacagaagtgaaggggtatacaaaaggaggacctggacatgaggaaccaatcccaatggcgacctatggatggaacctagtaaagctgcactctgggaaagacgtattttttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5843 - RNA, 9879 nt, synthetic construct
  misc_feature 1..9879: note = derived and/or modified CDS sequence (wt) from DENV-1__FJ898382__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgcaaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagcattgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggttcaggcggattcaggatgtgtaattaattggaaaggtagagaactcaagtgtggaagtggcatttttgtcaccaatgaagttcacacttggacagagcaatacaaatttcaagctgactcccctaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctcattcatagaagttaaaacatgtatctggccaaaatcccacactctatggagcaatggagttctggaaagtgaaatgataattccaaagatctatggaggaccaatatctcagcacaactacagaccaggatattttacacaagcagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaagaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgttcgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaatcctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccattcagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgttacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgctcagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaagtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatccccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggttcgtggagaggaaccttgtgaaaccagaagggaaagtcatagacctcggttgtggaagaggtggctggtcatactattgcgctgggctgaagaaagtcacagaagtgaaggggtatacaaaaggaggacctggacatgaggaaccaatcccaatggcgacctatggatggaacctagtaaagctgcactctgggaaagacgtattttttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5844 - RNA, 9879 nt, synthetic construct
  misc_feature 1..9879: note = derived and/or modified CDS sequence (wt) from DENV-1__FJ898383__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgcaaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccaatcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggttcaggcggattcaggatgtgtaattaattggaaaggtagagaactcaagtgtggaagtggcatttttgtcaccaatgaagttcacacttggacagagcaatacaaatttcaagctgactcccctaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctcattcatagaagttaaaacatgtatctggccaaaatcccacactctatggagcaatggagttctggaaagtgaaatgataattccaaagatctatggaggaccaatatctcagcacaactacagaccaggatattttacacaagcagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaagaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgttcgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaatcctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgctcagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggttcgtggagaggaaccttgtgaaaccagaagggaaagtcatagacctcggttgtggaagaggtggctggtcatactattgcgctgggctgaagaaagtcacagaagtgaaggggtatacaaaaggaggacctggacatgaggaaccaatcccaatggcgacctatggatggaacctagtaaagctgcactctgggaaagacgtattttttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5845 - RNA, 9879 nt, synthetic construct
  misc_feature 1..9879: note = derived and/or modified CDS sequence (wt) from DENV-1__FJ898384__SS-prME
  source 1..9879: mol_type = other RNA
tctgtgaccatgctccttatgctgatgcccacagccttggcgttccatttgaccacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaaggaccgaaacgtggatgtcctctgaaggcgcttggaaacagatacaaagagtggaaacttgggccctgagacacccaggattcacggtgatagccatttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaagccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaatttgaaatattcagtaatagtcaccgtccacacaggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactgaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagccaaccccatagtcactgacaaagaaaaaccagtcaacattgaggcagaaccgccttttggtgagagttacatcgtgataggagcaggtgaaaaagctttgaaattaagctggttcaagaaaggaagcagcatagggaaaatgtttgaggcaactgccagaggagcacgaaggatggccatactgggagacaccgcatgggactttggttccataggaggagtgttcacgtctgtcggaaaattagtacaccagatctttggaactgcatatggagtcttgttcagcggtgtttcctggaccatgaaaataggaataggagttctgctgacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggaaggtgtgtgtggaatacgatcagcaactcgtctcgagaacatcatgtggaagcaaatatcaaatgaactgaaccacattttacttgaaaatgacatgaaactcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcgatggtctctgcagggtcaggggaagtggatagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattttgaaattattgactgactttcaatcacatcagttgtgggctaccttgctgtccttgacatttatcagaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagccgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcaaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgttctcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaacccaaaaaatgtacaaacagcgccgggcaccttcaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaggctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaggcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtaattcaattgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgacaatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagagcccagaatgccttggacaatctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggatcggccatgtggctgttgaaaatcaccaccatgccgcaatgctggacgtggacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctaacagcggcggtattgatgctagtggctcattacgccataattggacctggactgcaagcaaaagctaccagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagtaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattcttcataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattttgaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatccagaatgttgctaaaccgattcacaatggctcacaggaaaccaacatatgaaagagacgtggacctaggtgccggaacaagacatgtggcagtggaaccagaggtagccaacctagatatcattggccagaggatagagaacataaaacatgaacataagtcaacatggcattatgatgaggacaacccatataaaacatgggcctaccatggatcatatgaggtcaagccgtcaggatcagcctcatccatggtcaatggcgtggtgaaactgctcaccaaaccatgggatgtcatccccatggtcacacaaatagccatgactgacaccacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgcgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactggccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatgtatccagttggggagatgttccatatttaggaaaaagggaagatcaatggtgtggatccctgataggcttaacagcaagggccacctgggccaccaacatacaagtggccataaaccaagtgagaagactacttgggaatgagaattatctagattacatgacatcaatgaagagattcaagaatgagagtgatcctgaaggggcactctggtga

SEQ ID NO: 5846 - RNA, 9879 nt, synthetic construct
  misc_feature 1..9879: note = derived and/or modified CDS sequence (wt) from DENV-1__FJ898385__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggatacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagacttcaatgaaatggtgttgttgacaatgaaagaaaaatcatggctagtccacaaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttccataggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggtctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggaggtgtagttgggatcttggctcaagggaaaaaaatgattaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccatcggctaatgtcggctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggaccaatatctcagcacaactacagaccaggatatttcacacaaacggcagggccgtggcacctaggtaagttggaactggattttgatttgtgtgagggcaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgttgatgactggaacattggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttctcacaattggattgagtctagtggcatctgtggagttaccaaattccttggaggagctgggggatggacttgcaatgggcattatgattttaaaattattgactgactttcagtcacatcagctgtgggctaccttgctgtccttgacatttatcaaaacaacgctttccttacactatgcatggaagacaatggctatgatactgtcaattgtatctctcttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgttagctgggccactaatagctggaggcatgctaatagcatgttatgttatatctggaagctcagccgacttatcactagagaaagcggctgaggtctcctgggaagaagaagcagaacactctggtgcctcgcacaatatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacatgggagaagaagtgcaggtgattgctgttgaaccaggaaaaaaccccaaaaatgtacaaacagcaccgggcaccttcaagacccctgaaggtgaagttggagccattgccctagattttaaacccggcacatctggatctcccatagtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcctacaagggttgtcgcttccgaaatggcagaggcgctcaagggaatgccaataagataccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaggcagctgcgatcttcatgacagccactcccccaggatcagtggaggcctttccacagagcaatgcagttatccaagatgaggaaagagacatccctgagagatcatggaactcaggatatgagtggatcactgactttccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccaatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactccgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacattgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgcgaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtgaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggattcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaatcactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatcttttcacccagcgaattggagatcccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatgtaccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggcaacctgggcctctaacatacaagtggccataaaccaagtgagaagactaattgggaatgagaattatctagattacatgacatcaatgaagagattcaagaacgagggtgatcccgaaggggcactctggtga

SEQ ID NO: 5847 - RNA, 9879 nt, synthetic construct
  misc_feature 1..9879: note = derived and/or modified CDS sequence (wt) from DENV-1__GQ868608__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttaggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagcaaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagacagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaagcatggctagtccacaaacaatggttcctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatacctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacatcagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatggaaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacccatggaatacaaatactcatggaaaagctggggaaaggctaaaatcataggggcagatgtgcagaatgccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcaggaccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcattatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacatgctaaccattctcctgaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgccttctgtctcccgtgagagttcccaattacaacatgattatcatggatgaagcacatttcaccgatccatccagcatagcggccagagggtacatctcaacccgagtgggtatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaataacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagagggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttaactggtggagtgacgctgttcttcctatcagggaggggcctagggaaaacatctatcggcctactctgtgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatacaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtctccatggcaaacatttttagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactttggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagattgatcctgaaggggcactctggtga

SEQ ID NO: 5848 - RNA, 9879 nt, synthetic construct
  misc_feature 1..9879: note = derived and/or modified CDS sequence (wt) from DENV-1__GQ199774__SS-prME
  source 1..9879: mol_type = other RNA
tctgtgaccatgctccttatgctgatgcctacagccttggcattccatttgactacacgaggaggagagccgcacatgatagttagcaagcaggaaagaggaaagtcacttttgttcaaaacctcagcaggtgtcaatatgtgcaccctcatagcgatggatttgggagagttatgtgaggacacaatgacttacaaatgtcctcgaattactgaggtggaaccagatgacgttgattgttggtgcaacaccacagacacatgggtgacctatggaacatgttcccaaactggcgagcaccgacgagacaagcgttccgtcgcactggccccacacgtgggacttggtttagaaacaagagccgaaacgtggatgtcctctgaaggcgcttggaaacagatacagaaagtggagacttgggccctgagacacccaggattcacggtgatagccctttttctagcacatgccataggaacatccatcacccagaaagggattattttcattctgttaatgctggtaacaccttccatggccatgcgatgcgtgggaataggcagcagggacttcgtggaagggctgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacattggtggaagaacaagacgcgaactttgtgtgccgacgaacgtttgtggacagaggctggggcaatggctgtgggctcttcggaaaaggaagcctgataacgtgtgctaagttcaagtgtgtgacaaaactggaaggaaagatagttcaatatgaaaatttgaaatattcagtaatagtcaccgtccacactggagaccagcaccaggtgggaaatgaaagcacagaacatgggacaattgcaactataacacctcaagctcctacgtcggaaatacagctgaccgactacggagctcttacattggactgctcacctagaacaggactggactttaatgaaatggtgttgttgacaatgaaagaaaaatcatggctagtccacaaacaatggtttctagacctgccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgaccggaacgacaacaatttttgcaggacacctgaaatgtagactaaagatggacaaactgactctaaaagggatgtcatatgtgatgtgcacaggttcattcaagctagagaaagaagtggctgagacccagcatggaaccgttctagtgcagattaaatacgaaggaacagatgcaccatgcaagatccctttttcgacccaagatgaaaaaggagtaacccagaacgggagattgataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaactagtacaccagatttttggaactgcatatggagttttgttcagcggtgtttcctggaccatgaaaataggaataggggttctgctgacatggctaggattaaactcaaggagcacgtccctttcgatgacgtgcattgcagttggtctaataacactatacctaggagtcatggttcaggcggattcaggatgtgtaattaattggaagggtagagaactcaaatgtggaagtggcatttttgtcaccaatgaagtccacacttggacagagcaatacaaatttcaagctgactccccaaagagactatcagcagccatcgggaaggcatgggaggagggtgtgtgtggaattcgatcagccacccgtctcgagaatatcatgtggaggcaaatatcaaatgaactgaaccacatcttacttgaaaatgacatgaaattcacagtagttgtaggagatgttgttgggatcttggctcaaggaaaaaagatggttaggccacaacccatggaacacaaatactcgtggaaaagctggggaaaagccaaaatcataggggcagatgtacagaacaccaccttcatcatcgatggcccaaacaccccagaatgccctgatgatcaaagagcatggaacatttgggaagttgaggactatggatttggaattttcacgacaaacatatggctgaaattacgtgactcctacacccaagtatgtgaccaccggctaatgtcagctgccatcaaggacagcaaggcagttcacgctgatatggggtactggatagaaagtgaaaagaatgagacctggaagttggcaagagcctcttttatagaagttaaaacatgtatctggccaaaatcccacaccctatggagcaatggagttctggaaagtgaaatgataattccaaaaatctatggaggaccaatatctcagcacaactacagaccaggatatttcacacaaacggcagggccgtggcacctaggcaagttggaactggattttgatttatgtgagggtaccacagttgttgtggatgaacattgtggaaatcgaggaccatctcttagaaccacaacagtcacaggaaagataattcatgaatggtgttgcagatcttgcacgctaccacccttacgtttcaaaggagaagatggatgttggtacggtatggaaatcagaccagtcagggaaaaggaagagaatctagtcaaatcaatggtctcagcagggtcaggggaagtggacagcttttcactaggactgttatgcatatcaataatgatcgaagaggtgatgagatccagatggagtagaaaaatgctgatgactggaacattggctgtgttcttccttctcataatgggacaattgacatggaatgatctgatcaggtcatgcatcatggttggagccaacgcttccgacaggatggggatgggaacgacgtacctagctttgatggccacttttaaaatgagaccaatgtttgctgtcgggctattattccgcagactaacatccagagaagttcttcttctaacaattggattgagtctagtggcatctgtggagttaccaaattccttggaggagctgggggatggacttgcaatgggcattatgattttaaaattattgactgactttcagtcatatcagctgtgggctaccttgctgtccttgacatttatcaaaacaacgttttccttgcactatgcatggaagacaatggctatggtactgtcaattgtatctctcctccccttatgcctgtccacgacctcccaaaaaacaacgtggctcccggtgctattgggatctcttggatgcaaaccactaaccatgtttcttatagcagaaaacaaaatctggggaaggaaaagttggcccctcaatgaaggaatcatggctgttggcatagtcagcatcctactaagttcactcctaaaaaatgatgtgccgctagctgggccactaatagctggaggcatgctaatagcatgttatgttatatcaggaagctcagccgacctatcactagagaaagcggctgaggtctcttgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcacaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcactttcaagacccctgaaggtgaagttggagccattgccttagatttcaaacccggcacatctggatctcctatcgtgaacagagaagggaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcgggaaaaacaagaagatatcttccagccatagtccgtgaggccataaaaaggaagctgcgcacactaattttggctcccacaagggttgtcgcttccgaaatggcagaggcgctcaaggggatgccaataaggtaccaaacaacagcagtgaagagtgaacacacaggaagagagatagttgatcttatgtgtcacgccactttcaccatgcgtctcctgtctcctgtgagagttcccaattacaacatgattatcatggatgaagcacatttcaccgatccatccagcatagcggccagaggatacatctcaacccgagtgggcatgggtgaagcagctgcgatcttcatgacagccactcccccaggatcggtggaagcctttccacagagcaatgcagttatccaagatgaggaaagagacattcctgaaagatcatggaactcaggctatgagtggatcactgacttcccaggtaaaacagtttggtttgttccaagcatcaaatcaggaaatgacattgccaactgcctaagaaagaatgggaaacgggtgattcaattgagcaggaaaacctttgatacagagtaccaaaaaacaaaaaataacgactgggactacgtcgttacaacagacatctccgaaatgggagcaaacttccgggccgacagggtgatagacccaagacggtgtctgaaaccggtaatactaaaagatggtccagagcgtgtcatcttagcaggaccgatgccagtgactgtggccagtgccgcccagaggagaggaagaattggaaggaaccacaataaggaaggtgaccagtacatctacatgggacagcctttaaacaacgatgaagatcacgcccactggacagaagcaaaaatgctccttgataatataaacacaccagaagggatcatcccagccctcttcgaaccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactccgacagaagatggtgctttgacggggaaaggaacaaccaggtgttggaggagaacatggacgtggagatctggacaaaagaaggagaaagaaaaaaactacgaccccgctggctagatgccagaacatactcagacccactggccctgcgcgagtttaaagagtttgcagcaggaagaagaagcgtctcaggtgatttaatattagaaatagggaaacttccacaacacttgacgcaaagggcccagaatgccttggacaacctggtcatgttgcacaactccgaacaaggaggaagagcctatagacatgcaatggaagaactgccagacactatagaaacgttgatgctcctagctttgatagctgtgttgactggtggagtgacgctgttcttcctatcaggaaggggcctagggaaaacatctatcggcctactctgcgtgatggcttcaagcgcactgctatggatggccagtgtggagccccattggatagcggcctccatcatactggagttcttcttgatggtgctgcttattccagagccagacagacaacgcactccgcaagacaaccagctggcatatgtggtgataggtttgttattcatgatacttacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctagccttggggtgctattctcaagtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccccgtggtttatgatgcaaaatttgagaaacaattaggccaaataatgttgttgatactatgcacatcacagatccttttgatgcggactacatgggccttgtgcgaatccatcacactggccactggacccctgaccacgctttgggagggatctccaggaaaattctggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctacaaaaggagtgggataatggaagtggacagatccgaagccaaagagggactaagaagaggagaaacaaccaaacatgcagtgtcgagaggaaccgccaaactgaggtggtttgtggagaggaatcttgtgaaaccagaagggaaagtcatagacctcggttgtggaagaggtggctggtcatactattgcgctgggctgaagaaagtcacagaagtgaagggatacacaaaaggaggacccggacatgaggaaccaatcccaatggcgacctatggatggaacctagtaaagctgcactccgggaaagacgtattctttataccacctgagaaatgtgacacccttttgtgtgatattggtgaatcctctccaaacccaactatagaagaaggaagaacgttacgcgtcctaaagatggtggaaccatggctcagaggaaaccaattctgcataaagattctgaatccttacatgccaagtgtggtggaaaccctggaacatatgcaaagaaaacatggaggaatgctagtgcgaaatccactttcaagaaattctacccatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaacaagacatgtggcagtggaaccagaggtagccaatctggatatcattggccagaggatagagaacataaaacatgaacacaagtcaacatggcattatgatgaggacaatccatataaaacatgggcctatcatggatcatatgaggtcaagccatcaggatcagcctcatccatggttaatggcgtggtgaaactgctcaccaaaccatgggatgtcatccctatggtcacacaaatagccatgactgacaccacaccctttggacaacagagggtgtttaaagagaaagttgacacacgtacaccaaaagcaaaacgaggcactgcacaaatcatggaggtgacagccaggtggttatggggctttctttccagaaacaaaaaaccaagaatttgtacaagagaggagttcacaagaaaagttaggtcaaacgcagccattggagcagtgttcgttgatgaaaatcaatggaactcagcaaaagaagcggtggaagatgagcggttctgggaccttgtgcacagagagagggagcttcacaaacagggaaaatgcgccacgtgtgtttacaacatgatggggaagagagagaaaaagctaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaactcggatacatactcagagacatatcaaagattcctgggggaaatatgtatgcagatgacacagccggatgggatacaaggataacagaggatgaccttcagaatgaggccaaaattactgacatcatggagcctgaacatgccctactggctacgtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctaataagacaaatggagtctgagggaatcttttcacccagcgagttggagaccccaaatttagccgagagagttctcgactggttggaaaaatatggcgtcgaaaggctaaaaagaatggcaatcagcggagatgactgcgtggtgaaaccaattgatgacaggtttgcaacagccttaacagctctgaatgatatgggaaaagtaagaaaagatataccacaatgggaaccctcaaaaggatggaatgattggcaacaagtgcctttttgttcacaccacttccaccagttgattatgaaggatggaagggaaatagtggtgccatgccgcaaccaagatgaacttgtgggtagggctagagtatcacaaggtgctggatggagcctgagagaaactgcatgcctaggcaagtcatatgcacaaatgtggcaactgatgtacttccacaggagagacctgagactagccgctaatgctatctgttcagccgttccagttgattgggtcccaaccagccgtaccacctggtcgatccatgcccatcaccaatggatgacaacagaagacatgttgtcagtgtggaatagggtttggatagaggaaaacccatggatggaggacaaaacccatatatccagctggggagatgttccatatttaggaaaaagggaagatcagtggtgtggatccctgataggcttaacagcaagggccacctgggccaccaacatacaagtggccataaaccaagtgagaagactaattgggaatgagaattatttagattacatgacatcaatgaagagattcaagaacgagagtgatcccgaaggggcactctggtga

SEQ ID NO: 5849 - RNA, 9879 nt, synthetic construct
  misc_feature 1..9879: note = derived and/or modified CDS sequence (wt) from DENV-1__GQ199775__SS-prME
  source 1..9879: mol_type = other RNA
tctgtgaccatgctccttatgctgatgcctacagccttggcattccatttgactacacgaggaggagagccgcacatgatagttagcaagcaggaaagaggaaagtcacttttgttcaaaacctcagcaggtgtcaatatgtgcaccctcatagcgatggatttgggagagttatgtgaggacacaatgacttacaaatgtcctcgaattactgaggtggaaccagatgacgttgattgttggtgcaacaccacagacacatgggtgacctatggaacatgttcccaaactggcgagcaccgacgagacaagcgttccgtcgcactggccccacacgtgggacttggtttagaaacaagagccgaaacgtggatgtcctctgaaggcgcttggaaacagatacagaaagtggagacttgggccctgagacacccaggattcacggtgatagccctttttctagcacatgccataggaacatccatcacccagaaagggattattttcattctgttaatgctggtaacaccttccatggccatgcgatgcgtgggaataggcagcagggacttcgtggaagggctgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacattggtggaagaacaagacgcgaactttgtgtgccgacgaacgtttgtggacagaggctggggcaatggctgtgggctcttcggaaaaggaagcctgataacgtgtgctaagttcaagtgtgtgacaaaactggaaggaaagatagttcaatatgaaaatttgaaatattcagtaatagtcaccgtccacactggagaccagcaccaggtgggaaatgaaagcacagaacatgggacaattgcaactataacacctcaagctcctacgtcggaaatacagctgaccgactacggagctcttacattggactgctcacctagaacaggactggactttaatgaaatggtgttgttgacaatgaaagaaaaatcatggctagtccacaaacaatggtttctagacctgccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgaccggaacgacaacaatttttgcaggacacctgaaatgtagactaaagatggacaaactgactctaaaagggatgtcatatgtgatgtgcacaggttcattcaagctagagaaagaagtggctgagacccagcatggaaccgttctagtgcagattaaatacgaaggaacagatgcaccatgcaagatccctttttcgacccaagatgaaaaaggagtaacccagaacgggagattgataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaactagtacaccagatttttggaactgcatatggagttttgttcagcggtgtttcctggaccatgaaaataggaataggggttctgctgacatggctaggattaaactcaaggagcacgtccctttcgatgacgtgcattgcagttggtctaataacactatacctaggagtcatggttcaggcggattcaggatgtgtaattaattggaagggtagagaactcaaatgtggaagtggcatttttgtcaccaatgaagtccacacttggacagagcaatacaaatttcaagctgactccccaaagagactatcagcagccatcgggaaggcatgggaggagggtgtgtgtggaattcgatcagccacccgtctcgagaatatcatgtggaggcaaatatcaaatgaactgaaccacatcttacttgaaaatgacatgaaattcacagtagttgtaggagatgttgttgggatcttggctcaaggaaaaaagatggttaggccacaacccatggaacacaaatactcgtggaaaagctggggaaaagccaaaatcataggggcagatgtacagaacaccaccttcatcatcgatggcccaaacaccccagaatgccctgatgatcaaagagcatggaacatttgggaagttgaggactatggatttggaattttcacgacaaacatatggctgaaattacgtgactcctacacccaagtatgtgaccaccggctaatgtcagctgccatcaaggacagcaaggcagttcacgctgatatggggtactggatagaaagtgaaaagaatgagacctggaagttggcaagagcctcttttatagaagttaaaacatgtatctggccaaaatcccacaccctatggagcaatggagttctggaaagtgaaatgataattccaaaaatctatggaggaccaatatctcagcacaactacagaccaggatatttcacacaaacggcagggccgtggcacctaggcaagttggaactggattttgatttatgtgagggtaccacagttgttgtggatgaacattgtggaaatcgaggaccatctcttagaaccacaacagtcacaggaaagataattcatgaatggtgttgcagatcttgcacgctaccacccttacgtttcaaaggagaagatggatgttggtacggtatggaaatcagaccagtcagggaaaaggaagagaatctagtcaaatcaatggtctcagcagggtcaggggaagtggacagcttttcactaggactgttatgcatatcaataatgatcgaagaggtgatgagatccagatggagtagaaaaatgctgatgactggaacattggctgtgttcttccttctcataatgggacaattgacatggaatgatctgatcaggtcatgcatcatggttggagccaacgcttccgacaggatggggatgggaacgacgtacctagctttgatggccacttttaaaatgagaccaatgtttgctgtcgggctattattccgcagactaacatccagagaagttcttcttctaacaattggattgagtctagtggcatctgtggagttaccaaattccttggaggagctgggggatggacttgcaatgggcattatgattttaaaattattgactgactttcagtcatatcagctgtgggctaccttgctgtccttgacatttatcaaaacaacgttttccttgcactatgcatggaagacaatggctatggtactgtcaattgtatctctcctccccttatgcctgtccacgacctcccaaaaaacaacgtggctcccggtgctattgggatctcttggatgcaaaccactaaccatgtttcttatagcagaaaacaaaatctggggaaggaaaagttggcccctcaatgaaggaatcatggctgttggcatagtcagcatcctactaagttcactcctaaaaaatgatgtgccgctagctgggccactaatagctggaggcatgctaatagcatgttatgttatatcaggaagctcagccgacctatcactagagaaagcggctgaggtctcttgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcacaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcactttcaagacccctgaaggtgaagttggagccattgccttagatttcaaacccggcacatctggatctcctatcgtgaacagagaagggaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcgggaaaaacaagaagatatcttccagccatagtccgtgaggccataaaaaggaagctgcgcacactaattttggctcccacaagggttgtcgcttccgaaatggcagaggcgctcaaggggatgccaataaggtaccaaacaacagcagtgaagagtgaacacacaggaagagagatagttgatcttatgtgtcacgccactttcaccatgcgtctcctgtctcctgtgagagttcccaattacaacatgattatcatggatgaagcacatttcaccgatccatccagcatagcggccagaggatacatctcaacccgagtgggcatgggtgaagcagctgcgatcttcatgacagccactcccccaggatcggtggaagcctttccacagagcaatgcagttatccaagatgaggaaagagacattcctgaaagatcatggaactcaggctatgagtggatcactgacttcccaggtaaaacagtttggtttgttccaagcatcaaatcaggaaatgacattgccaactgcctaagaaagaatgggaaacgggtgattcaattgagcaggaaaacctttgatacagagtaccaaaaaacaaaaaataacgactgggactacgtcgttacaacagacatctccgaaatgggagcaaacttccgggccgacagggtgatagacccaagacggtgtctgaaaccggtaatactaaaagatggtccagagcgtgtcatcttagcaggaccgatgccagtgactgtggccagtgccgcccagaggagaggaagaattggaaggaaccacaataaggaaggtgaccagtacatctacatgggacagcctttaaacaacgatgaagatcacgcccactggacagaagcaaaaatgctccttgataatataaacacaccagaagggatcatcccagccctcttcgaaccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactccgacagaagatggtgctttgacggggaaaggaacaaccaggtgttggaggagaacatggacgtggagatctggacaaaagaaggagaaagaaaaaaactacgaccccgctggctagatgccagaacatactcagacccactggccctgcgcgagtttaaagagtttgcagcaggaagaagaagcgtctcaggtgatttaatattagaaatagggaaacttccacaacacttgacgcaaagggcccagaatgccttggacaacctggtcatgttgcacaactccgaacaaggaggaagagcctatagacatgcaatggaagaactgccagacactatagaaacgttgatgctcctagctttgatagctgtgttgactggtggagtgacgctgttcttcctatcaggaaggggcctagggaaaacatctatcggcctactctgcgtgatggcttcaagcgcactgctatggatggccagtgtggagccccattggatagcggcctccatcatactggagttcttcttgatggtgctgcttattccagagccagacagacaacgcactccgcaagacaaccagctggcatatgtggtgataggtttgttattcatgatacttacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctagccttggggtgctattctcaagtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccccgtggtttatgatgcaaaatttgagaaacaattaggccaaataatgttgttgatactatgcacatcacagatccttttgatgcggactacatgggccttgtgcgaatccatcacactggccactggacccctgaccacgctttgggagggatctccaggaaaattctggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctacaaaaggagtgggataatggaagtggacagatccgaagccaaagagggactaagaagaggagaaacaaccaaacatgcagtgtcgagaggaaccgccaaactgaggtggtttgtggagaggaatcttgtgaaaccagaagggaaagtcatagacctcggttgtggaagaggtggctggtcatactattgcgctgggctgaagaaagtcacagaagtgaagggatacacaaaaggaggacccggacatgaggaaccaatcccaatggcgacctatggatggaacctagtaaagctgcactccgggaaagacgtattctttataccacctgagaaatgtgacacccttttgtgtgatattggtgaatcctctccaaacccaactatagaagaaggaagaacgttacgcgtcctaaagatggtggaaccatggctcagaggaaaccaattctgcataaagattctgaatccttacatgccaagtgtggtggaaaccctggaacatatgcaaagaaaacatggaggaatgctagtgcgaaatccactttcaagaaattctacccatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaacaagacatgtggcagtggaaccagaggtagccaatctggatatcattggccagaggatagagaacataaaacatgaacacaagtcaacatggcattatgatgaggacaatccatataaaacatgggcctatcatggatcatatgaggtcaagccatcaggatcagcctcatccatggttaatggcgtggtgaaactgctcaccaaaccatgggatgtcatccctatggtcacacaaatagccatgactgacaccacaccctttggacaacagagggtgtttaaagagaaagttgacacacgtacaccaaaagcaaaacgaggcactgcacaaatcatggaggtgacagccaggtggttatggggctttctttccagaaacaaaaaaccaagaatttggacaagagaggaggtcacaagaaaagttaggtcaaacgcaggcattggagcaggggtcggtgatgaaaatcaatggaactcagcaaaaaaaggggtggaagatgagcggttctgggaccttgtgcacagagagagggagcttcacaaacagggaaaatgcgccacgtgtgtttacaacatgatggggaagagagagaaaaagctaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaactcggatacatactcagagacatatcaaagattcctgggggaaatatgtatgcagatgacacagccggatgggatacaaggataacagaggatgaccttcagaatgaggccaaaattactgacatcatggagcctgaacatgccctactggctacgtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctaataagacaaatggagtctgagggaatcttttcacccagcgagttggagaccccaaatttagccgagagagttctcgactggttggaaaaatatggcgtcgaaaggctaaaaagaatggcaatcagcggagatgactgcgtggtgaaaccaattgatgacaggtttgcaacagccttaacagctctgaatgatatgggaaaagtaagaaaagatataccacaatgggaaccctcaaaaggatggaatgattggcaacaagtgcctttttgttcacaccacttccaccagttgattatgaaggatggaagggaaatagtggtgccatgccgcaaccaagatgaacttgtgggtagggctagagtatcacaaggtgctggatggagcctgagagaaactgcatgcctaggcaagtcatatgcacaaatgtggcaactgatgtacttccacaggagagacctgagactagccgctaatgctatctgttcagccgttccagttgattgggtcccaaccagccgtaccacctggtcgatccatgcccatcaccaatggatgacaacagaagacatgttgtcagtgtggaatagggtttggatagaggaaaacccatggatggaggacaaaacccatatatccagctggggagatgttccatatttaggaaaaagggaagatcagtggtgtggatccctgataggcttaacagcaagggccacctgggccaccaacatacaagtggccataaaccaagtgagaagactaattgggaatgagaattatttagattacatgacatcaatgaagagattcaagaacgagagtgatcccgaaggggcactctggtga

SEQ ID NO: 5850 - RNA, 9876 nt, synthetic construct
  misc_feature 1..9876: note = derived and/or modified CDS sequence (wt) from DENV-1__FJ882546__SS-prME
  source 1..9876: mol_type = other RNA
tctgtgaccatgctccttatgctgatgcctacagccttggcgttccatttgaccacacgagggggagagccgcacatgatagtcagcaagcaggaaagaggaaagtcacttttgtttaagacctcagcaggtgtcaacatgtgtacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtactggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagtttaagtgtgtgacaaaactggaaggaaagatagtccaatatgaaaacttgaaatactcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaggaaacttggaacagacaagatttgctggtgacatttaagacagctcatgcaaagaagcaggaagtagtcgtactaggatcacaagaaggagcaatgcacactgcgctgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaggtggctgagacccagcatggaaccgttctagtgcagattaaatacgaaggaacagatgcaccatgcaagatccccttttcgacccaagatgagaaaggagtaacccagaatgggagattgataacagccaaccccatagtcactgacaaagaaaaaccagtcaacattgaggcagaaccgccttttggtgagagttacatcgtgataggagcaggtgaaaaagctttgaagctaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagtcggcctagtaacgctatacttaggagtcatggttcaggcagattcaggatgtgtaattaactggaaaggtagagaactcaaatgtggaagtggcatttttgttaccaatgaagttcatacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaactcacagtggttgtaggagatgttgctgggatcttgggccaagggaagaaaatgattaggccacaacccatggaatataaatactcgtggaaaagctggggaaaggctaaaatcataggggcagatgcacagaacaccaccttcatcatcgacggcccaaacaccccggaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcctccgacaggatggggatgggaacgacgtatctagctctgatggccacttttaaaatgagaccaatgtttgctgtggggctgctattccgcagactaacatccagagaagttcttcttctaacaattggattgagtctagtggcatctgtggagttaccaaattccttggaggagctgggggatggacttgcaatgggcattatgattttaaaattgttgactgactttcaatcacatcagctgtgggctaccttgctgtccttgacatttatcaaaacaacattttctttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatttggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatactagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcgaggatcctggaacacgggagaagaagtgcaggtgattgctgttgaaccagggaaaaaccccaaaaatgtacaaacggcgccgggcacctttaagacccctgaaggcgaagttggagccattgctctagattttaaacccggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacattttacagatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcaccgacttcccaggcaaaacagtttggtttgttccaagcattaaatcaggaaatgacattgccaactgcttaagaaagaatgggaagcgggtgattcaattgagcaggaaaacctttgacacagagtaccaaaaaacaaaaaataacgactgggactacgttgtcacaacagacatctccgaaatgggagcgaatttccgggccgacagggtgatagacccaagacggtgtctgaaaccggtaatactaaaggatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcagtagacggggaatacagactgcgaggtgaagcaaggaaaacgtttgtggagctcatgagaagaggagatctacctgtctggctatcctacaaagttgcttcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaaaaagcgtctcaggtgatctaatattagaaataggaaaacttccacaacacttgacgcaaagggcccagaatgccttggacaacctggttatgctgcacaattccgaacaaggaggaagagcctatagacatgcaatggaagaactgccagacaccatagaaacgttaatgctcctagctttgatagctgtgttaactggtggagtgacgctgttcttcctatcaggaaggggcctagggaaaacatctatcggtctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggagaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacagcaaacatttctctgacagccattgcaaaccaggcagctatattgatgggacttgacaaaggatggccaatatcgaagatggacataggggttccacttctcgctttggggtgctattcccaggtgaatccactgacgctgacagcggcggtattgatgctagtggcccattacgccataattggacctggactgcaagcaaaagctactagagaagctcaaaaaaggacagcggccggaataatgaaaaatccaaccgttgatggaatcgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatttagcaggagcaggtctggccttctcattaatgaaatctctaggaggaggtaggagaggcacaggagcccaaggggaaacactgggagagaaatggaaaagacagctgaaccaactgagcaagtcagaattcaacacctataaaaggagtgggattatggaagtggacagatctgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaggtcacagaagtgaagggatatacaaaaggaggacctggacatgaagaaccaatcccaatggcgacctatggatggaacctagtaaagctgcactccgggaaagacgtattcttcataccacctgagaaatgtgacacccttttgtgtgatattggtgagtcatctccaaacccaactatagaggaaggaagaacgctacgcgtcctaaagatggtggaaccatggctcagaggaaaccaattctgcataaaaattctgaatccctacatgccaagtgtggtggaaactctggagcaaatgcaaagaaaacatggaggaatgctagtgcgaaatccactttcaagaaattctacccatgaaatgtattgggtttcatgtggaacaggaaacattgtgtcagcagtaaacatgacatccagaatgttgctaaatcgattcacaatggctcacaggaaaccaacatatgaaagagacgtggacctaggcaccggaacaagacatgtggcagtggaaccagaggtagccaacctagatattattggccagaggatagagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgaactacaccttgggcaacagagggtgtttaaagagaaagttgacacacgcacaccacgagcaaaacgaggtacagcacaaatcatggagatgacagccaggtggttatggggatttctttctagaaacaagataccaagaatttgtacaagagaggagttcacaagaaaagttaggtcaaacgcagccatcggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagtttggaaaggcaaaaggaagtcgtgcaatatggtacatgtggttgggagcacgctttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgttatatccagacgtgaccagagaggaagtggccaggtcggaacttatggcttaaacactttcaccaacatggaagcccagctgataagacaaatggagtctgaggaaatcttttcacccagtgaattagagaccccaaatttagccgagagagctctcgattggctggaaaaatatggcgtcgaaaggctaaaaagaatggcaatcagtggagatgattgcgtagtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacaggagagacctaagactagccgctaatgctatctgttcagccgttccagttgattgggtcccaactagccgcaccacctggtcgatccatgcccatcaccaatggatgacaacagaagacatgctgtcagtgtggaatagggtttggatagaggaaaacccatggatggaggacaaaacccatatatccagctgggaagatgttccatatttagggaaaagggaagatcaatggtgtggatccctgataggcttaacagcaagggccacctgggccactaacatacaagtggctataaaccaagtgagaagactaattgggaatgagaattatctagattacatgacatcaatgaagagattcaagaacgagagtgatcccgaaggggcactctggtga

SEQ ID NO: 5851 - RNA, 9879 nt, synthetic construct
  misc_feature 1..9879: note = derived and/or modified CDS sequence (wt) from DENV-1__KF921935__SS-prME
  source 1..9879: mol_type = other RNA
tctgtgaccatgctccttatgctgatgcctacagctttggcgttccatttgaccacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaagcagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactatgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaattggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaattttcgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatcccttttttgacccaagatgaaaaaggagtaacccagaatgggagattgataacagctaaccccatagttactgacaaagaaaaacctgtcaacattgaggcagaaccgccctttggtgagagttacatcataataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggtccaggcggattcaggatgtgtaattaattggaaaggtagagaactcaaatgtggaagtggcatttttgtcaccaatgaagtccacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaaagaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcccacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctatccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacttgatctcatatggaggaggttggaggcttcaaggatcctggaacacaggagaagaagtgcaggtgattgctgttgaaccagggaaaaaccccaaaaacgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgaccgtggccagtgccgcccagaggagaggaagaattggaaggaaccacaataaggaaggtgatcagtacatctacatgggacagcctctaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgttctgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgagacacacaatcgaaaacacaacggcaaatatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaaatcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagagatagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacacaacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggggcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactggccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagggtgatcccgaaggggcactctggtga

SEQ ID NO: 5852 - RNA, 9879 nt, synthetic construct
  misc_feature 1..9879: note = derived and/or modified CDS sequence (wt) from DENV-1__GQ199776__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgcaaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggttcaggcggattcaggatgtgtaattaattggaaaggtagagaactcaagtgtggaagtggcatttttgtcaccaatgaagttcacacttggacagagcaatacaaatttcaagctgactcccctaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaagtactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctcattcatagaagttaaaacatgtatctggccaaaatcccacactctatggagcaatggagttctggaaagtgaaatgataattccaaagatctatggaggaccaatatctcagcacaactacagaccaggatattttacacaagcagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaagaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgttcgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacaccagctgtgggctaccttgctgtccttgacatttatcaaaacaacgctttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagccgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaatcctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgctcagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggttcgtggagaggaaccttgtgaaaccagaagggaaagtcatagacctcggttgtggaagaggtggctggtcatactattgcgctgggctgaagaaagtcacagaagtgaaggggtatacaaaaggaggacctggacatgaggaaccaatcccaatggcgacctatggatggaacctagtaaagctgcactctgggaaagacgtattttttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggtagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5853 - RNA, 9879 nt, synthetic construct
  misc_feature 1..9879: note = derived and/or modified CDS sequence (wt) from DENV-1__GQ199777__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaaatcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgtcataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttaaagacggaagtcacaaaccctgccgtcctgcgcaaactgtgcattgaagctaaaatatcaaacaccaccaccgactcaagatgtccaacacaaggagaagccacactagtggaagaacaagacgcgaacttcgtgtgtcgacgaacgttcgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgtccacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaagtgcagactaaagatggacaaactgactctaaaagggatgtcatatgtgatgtgcacaggcttattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagttactgacaaagaaaaaccagtcaacattgaggcagaaccgccctttggtgagagttacatcataataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcttggaccatgaaaataggaataggggttctgctgacatggctgggattaaactcaaggagcacgtccctttcgatgacgtgcattgcagttggcctagtaacactatacctaggagtcatggttcaggcggattcaggatgtgtaatcaattggaaaggtagagaactcaaatgtggaagtggtatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattggctgactttcaatcacatcaactgtgggctaccttgctgtccttgacatttatcaaaacaacgttttccttgcactacgcatggaagacaatggctatggtactgtcaattgtatctctcttccctttatgcctgtccacgacctcccaaaaaacaacatggcttccggtgctattaggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatccggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaggctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagcgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggtgaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgcttctagctctgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccggagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5854 - RNA, 9879 nt, synthetic construct
  misc_feature 1..9879: note = derived and/or modified CDS sequence (wt) from DENV-1__GQ199778__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgcaaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagaggcttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacactatacctaggagtcatggttcaggcggattcaggatgtgtaatcaattggaaaggtagagaactcaagtgtggaagtggcatttttgtcaccaatgaagttcacacttggacagagcaatacaaatttcaagctgactcccctaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctcattcatagaagttaaaacatgtatctggccaaaatcccacactctatggagcaatggagttctggaaagtgaaatgataattccaaagatctatggaggaccaatatctcagcacaactacagaccaggatattttacacaagcagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccaatcaaggaaaaggaagaaaatctagtcaaatcaatggtctctgcagggtcaggggaagtggacagcttttcactaggactgctatgcatatcaataatgatcgaggaggtgatgagatccagatggagtagaagaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgttcgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactacgcatggaagacaatggctatggtactgtcaattgtatctctcttccctttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaatcctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgctcagaggagaggaagaattggaaggaaccacaataaggaaggtgatcagtacatctacatgggacagcctttaaacaacgatgaagatcacgctcactggacagaagcaaaaatgctccttgataatataaacacaccagaagggatcatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagcattgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagagggattgaaaagaggagaaacaaccaaacatgcagtgtcgagaggaaccgctaaactgaggtggttcgtggagaggaaccttgtgaaaccagaagggaaagtcatagacctcggttgtggaagaggtggctggtcatactattgcgctgggctgaagaaagtcacagaagtgaaggggtatacaaaaggaggacctggacatgaggaaccaatcccaatggcgacctatggatggaacctagtaaagctgcactctgggaaagacgtattttttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 5855 - RNA, 9879 nt, synthetic construct
  misc_feature 1..9879: note = derived and/or modified CDS sequence (wt) from DENV-1__GQ199780__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagatagttcaatatgaaaacttgaaatattcagtaatagtcaccgttcacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagaaaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacatcttacttgaaaatgacatgaaattcacagtggttgtaggagatgttgctggaatcttggctcaagggaaaaaaatgattaggccacaacctatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagtgcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtaaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataacataaacacaccagaagggattatcccagccctcttcgagccggagagagaaaagagtgcagcaatagacggggaatatagactgcggggtgaagcaaggaaaacgtttgtggagcttatgagaagaggagatttacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaatctggttatgttgcacaactccgaacaaggaggaagagcctatagacatgcaatggaggaactgccagacaccatagaaacgttgatgctcctagctttgatagctgtgttgactggtggagtgacgctgttcttcctatcaggaaggggcctagggaaaacatctatcggcctactctgcgtgatggcttcaagcgtactgttatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgataaaggatggccaatatcgaagatggacataggagttccacttctcgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagacctcggttgtggaagaggtggctggtcatattattgcgccgggctgaagaaagtcacagaagtgaagggatatacgaaaggaggacctggacatgaggagccaattccaatggcgacctatggatggaacctagtaaaactgcactccgggaaagacgtattctttataccacccgagaaatgcgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattacagacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaattttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgatatgggaaaagttagaaaagatgtaccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagatcaatggtgtggatccctgataggcttaacagcaagggccacctgggccaccaacatacaagtggccataaaccaagtgagaagactaattgggaatgagaactatctagattacatgacatcaatgaagagattcaagaacgagagtgatcctgaaggggcactctggtga

SEQ ID NO: 5856 - RNA, 9879 nt, synthetic construct
  misc_feature 1..9879: note = derived and/or modified CDS sequence (wt) from DENV-1__GQ199781__SS-prME
  source 1..9879: mol_type = other RNA
tctgtgaccatgctacttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacatttaagacagctcatgcaaagaagcaggaagtagtcgtactaggatcacaagaaggagcaatgcacaccgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaatccagaatgggagattgataacagcaaatcctatagtcactgacaaagaaaaaccagtcaacattgaggcagaaccgccttttggtgagagttacatcgtgataggagtaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtgcaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgcacagaacacaaccttcatcatcgacggcccaaacaccccagaatgccctgatgatcaaagagcatggaacatttgggaagttgaggactatggatttggaattttcacgacaaatatatggttgaaattgcgtgactcctacactcaagcgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatggtaattccaaaaatctatggaggaccaatatctcagcacaactacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgtagatcttgtacgctaccacccttacgttttaaaggagaggatgggtgttggtacggtatggaaatcagaccagttaaggaaaaggaagagaatctagtcaaatcaatggtctctgcagggtcaggggaagtggacagcttttcactaggactgctatgcatatcaataatgatcgaagaggtgatgagatccagatggagtagaaaaatgttgatgactggaacattggctgtgttcctccttctcataatggggcaattgacatggaatgatctgatcagattatgcattatggttggagccaacgcttccgacaggatggggatgggaacgacgtacctagctctgatggccacttttaagatgagaccaatgtttgctgtcgggctattattccgtagactaacatccagagaagttctccttcttacaattggattgagtctagtggcatctgtggagttgccaaattccttggaagagctgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttatagcagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatattagtggaggtccaagatgatggaactatgaagataaaggatgaagagagagatgacacgctaaccattcttcttaaagcaactctgctagcagtttcaggggtgtatccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaaaccaaagcatcacaagaaggtcccctaccagagattgaagatgaggtgtttaggaaaagaaacttaacaataatggacctacatccaggatcggggaaaacaagaagatatctcccagccataatccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctactgtctcctgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtatcaaaaaacaaaaaataacgattgggactatgtcgtcacaacagacatctccgaaatgggagcaaacttccgagccgacagggtgatagacccaagacggtgcctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgacaatataaacacaccagaagggattatcccagccctcttcgagccagagagggaaaagagtgcagcaatagacggggaatacagactgcggggtgaagcaaggaagacgtttgtggagctcatgagaagaggagatctacctgtttggctatcctacaaagttgcctcagaaggcttccagtactctgatagaagatggtgcttcgacggggaaagaaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgctttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtggacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatactatgcacttcacagatcctcttgatgaggactacatgggccttgtgcgaatccatcacactggccactggacctctaaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttgcaccacctgagaaatgtgacacacttttgtgtgatattggtgagtcctctccaaacccaaccatagaagaaggaagaacgttacgcgtcctaaaaatggtggaaccatggctcagagggaaccaattctgcataaaaattctaaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacttggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggttacacaaatagccatgactgacactacaccctttggacaacagagggtgttcaaagagaaagttgacacgcgcacaccaaaagcaagacgaggcacagcacaaatcatggaggtgacagccagatggttatggggttttctttccagaaacaagaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaacatggcgtcgaaaggctgaaaagaatggcaatcagcggggatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagagaaatagtggtgccatgccgtaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtgtccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 5857 - RNA, 9879 nt, synthetic construct
  misc_feature 1..9879: note = derived and/or modified CDS sequence (wt) from DENV-1__GQ199782__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcaatggatttgggagagttatgcgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaacttttgaagacggaagtcacaaaccctgccgtcctgcgcaaactgtgcattgaagccaaaatatcaaacaccaccaccgactcaagatgtccaacacaaggagaagccacacttatggaagaacaagacgcgaactttgtgtgtcgacgaacgtttgtggatagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagcccttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttctgtaggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatctttgtcaccaatgaagttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatatacagaacaccaccttcatcatcgacggcccaaacaccccagaatgccctgatgatcaaagagcatggaacatttgggaagttgaggactatggatttggaattttcacgacaaatatatggttgagattgcgtgactcctacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaatggagttctggaaagtgaaatgataattccaaagatctatggaggacccatatctcagcacaactacagaccaggatacttcacacaaacggcagggccatggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggcatggaaatcagaccagttaaggaaaaggaagagaatctagtcaaatcaatggtctctgcagggtcaggggaagtggacagcttctcactaggactgctatgcatatcaataatggtcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaataagaccaatgtttgctgtcgggctattagtccgtagactaacatccagagaagttctccttcttacaattggattgagtctagtggcatctgtggagttaccaaattccttggaggagctgggagatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactaaccatgtttcttataacagaaaacaaaatctggggaaggaaaagttggcccctcaatgaaggaatcatggctgttggagtagtcagcattctactaagttcactccttaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatactagtggaggtccaagatgatggaactatgaagataaaggatgaagagagagatgacacgctaaccattctccttaaagcaactctgctagcagtttcaggggtgtacccattatcaataccagcgaccctttttgtgtggtacttctggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaatagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattattatggatgaagcacatttcaccgatccatccagtatagcagccagagggtacatctcaacccgagtgggcatgggtgaagcagctgcgatcttcatgacagccactcctccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgtgagtttaaagagtttgcagcaggaagaagaagcgtctcaggtgatctaatattagaaatagggaagcttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcttactctgcgtgatggcctcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtggcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttgggatgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacaactaggccaaataatgttgttaatattatgcacttcacagatcctcttgatgaggactacatgggccttgtgcgaatccatcacactggccactggacctttgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggagagacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaactagacatgtggcagtggaaccagaggtagccaacctggatatcattggccagaggatagagaacatgaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaggagaaagttgacacgcgcacaccaaaagcaaaacgaggcacagcacaaatcatggaggtgacagccagatggttatggggttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagagagcttcacaaacagggaaaatgtgccacgtgtgtttacaacatgatggggaagagagagaaaaaactaggagagttcggaaaggcaaaaggaagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgctcagccgttccagttgattgggtcccaaccagtcgcactacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 5858 - RNA, 9879 nt, synthetic construct
  misc_feature 1..9879: note = derived and/or modified CDS sequence (wt) from DENV-1__GQ199783__SS-prME
  source 1..9879: mol_type = other RNA
tctgtgaccatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggaaacttgggccctgagacacccaggattcacggtgatagccctttttctagcacatgccataggaacatccatcacccagaaggggattattttcattttgttaatgctggtaacaccatccatggccatgcgatgcgtgggaataggcagcagggacttcgtggaaggaacgtcaggagcaacttgggtagacgtggtactggaacatggaagctgcgtcaccaccatggcgaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacacttatggaagaacaagacgcgaactttgtgtgccgacgaacgtttgtggatagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctcccacgtcggaaatacagctgaccgactacggagctcttacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagactgataacagctaatcctatagtcactgacaaagaaaaaccagtcaacattgaggcagaaccgccttttggtgagagttacatcgtaataggagcaggtgaaaaagctttgaaactaagctggttcaagaaaggaagtagcatagggaaaatgtttgaggcaactgccagaggagcacgaagaatggccatactgggggacaccgcatgggactttggttctgtaggaggagtgttcacatctgttggaaaactagtacaccagatttttggaactgcatatggagttttgttcagcggtgtttcctggaccatgaaaataggaataggggttctgctgacatggctaggattaaactcaaggagcacgtccctttcaatgacgtgcattgcagttggcctagtaacactatacctaggagtcatggttcaggcggattcaggatgtgtaattaattggaaaggaagagagctcaaatgtggaagtggcatctttgtcaccaatgaagttcacacttggacagagcaatacaaatttcaagctgactccccaaagagactatcagcagccatcgggaaggcatgggaggagggtgtgtgtggaattcgatcatccactcgtctcgagaatatcatgtggaagcaaatatcaaatgaactgaaccacatcttacttgaaaatgacatgaaattcacagtggttgtaggagatgtagttgggatcttggctcaaggaaaaaaaatgattaggccacaacccatggaacacaaatactcgtggaaaagctggggaaaagctaaaatcataggggcagatgtacagaataccaccttcatcatcgacggcccaaacaccccagaatgccctgatgatcaaagagcatggaacatttgggaagttgaggactatggatttggaattttcacgacaaatatatggttgaaattgcgtgactcctacacccaagtgtgtgaccaccggctaatgtcagctgccatcaaggacagcaaggcagttcatgctgacatggggtactggatagaaagtgaaaagaacgagacctggaagctggcaagagcctccttcatagaagttaaaacatgcatttggccaaaatcccacactctatggagcaatggagttctggaaagtgaaatgataattccaaagatctatggaggaccaatatctcagcacaactacagaccaggatatttcacacaaacagcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggcatggaaatcagaccagttaaggaaaaggaagagaatctagtcaaatcaatggtctctgcagggtcaggggaagtggacagcttctcactgggactgctatgcatatcaataatgatcgaagaggtgatgagatccagatggagtagaaaaatgttgatgactggaacactggctgtgttcctccttcttataatggggcaattgacatggaatgatctgatcagattatgcatcatggttggagccaacgcttccgacaggatggggatgggaacgacgtacctagctctgatggccacttttaaaataagaccaatgtttgctgtcgggctattattccgtagactaacatccagagaagttctccttcttacaattggattgagtctagtggcatctgtggagttaccaaattccttggaggagctgggagatggacttgcaatgggtattatgattttaaaattattgactgactttcagtcacatcagctgtgggctaccttgctgtccttgacatttattaaaacaacgctttccttacaccatgcatggaagacaatggctatggtactgtcaattgtatctctcttccccttatgcctgtccacgacctcccaaaaaacaacgtggcttccggtgctattgggatctcttggatgcaaaccactaaccatgtttcttataacagaaaacaaaatctggggaaggaaaagttggcccctcaatgaaggaatcatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcgcacaatatactagtggaggtccaagatgatggaactatgaagataaaggatgaagagagagatgacacgctaaccattctccttaaagcaactctgctagcagtttcaggggtgtacccattatcaataccagcgaccctttttgtgtggtacttctggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaaaccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggcccccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcctccaggatcagtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcaggaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgtgtcattctagcaggaccgatgccagtaactgtggccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggattatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgtgagtttaaagagtttgcagcaggaagaagaagcgtctcaggtgatctaatattagaaatagggaagcttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgttgactggtggagtgacgctgttcttcctatcaggaaggggcctagggaaaacatctatcggcttactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttgggatgctattcacaggtgaatccactgacgctgacggcggcggtattgatgctagtggctcattacgccataattggacctggactgcaagcaaaagctactagagaagctcaaaaaaggacagcggccggaataatgaaaaatccaacagttgatggaattgttgcaatagatttggaccctgtggtctatgatgcaaaatttgagaaacaactaggccaaataatgttgttaatactatgcacttcacagatcctcttgatgaggaccacatgggccttgtgcgaatccatcacactggccactggacctctgaccacgctttgggagggatctccagggaaattttggaacaccacgatagcggtttccatggcaaacattttcagaggaagttatctagcaggagcaggtctggccttctcattaatgaaatctttaggaggaggtaggagaggcacgggagcccaaggagaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggctgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaaccagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttccagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagagagcttcacaaacagggaaaatgtgccacgtgtgtttacaacatgatggggaagagagagaaaaaactaggagagttcggaaaggctaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagacatatcaaagattccagggggaaatatgtatgcagatgacacagccggatgggatacaaggataacagaggatgatcttcagaatgaggccaaaattactgacatcatggagcccgaacatgccctactggctacgtcaatcttcaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgagggaatctttttacccagcgaattggagaccccaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgctcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcctccaacatacaagtggccataaaccaagtgagaagactaattgggaatgagaattatctagattacatgacatcaatgaagagattcaagaacgagggtgatcccgaaggggcactctggtga

SEQ ID NO: 5859 - RNA, 9879 nt, synthetic construct
  misc_feature 1..9879: note = derived and/or modified CDS sequence (wt) from DENV-1__GQ199784__SS-prME
  source 1..9879: mol_type = other RNA
tctgtgactatgcttcttatgctgatgcccacagccttggcgttccatctgactacacgagggggagagccgcatatgatagttaccaagcaggaaagaggaaagtcacttttgtttaagacctcagcaggcgtcaacatgtgcacccttatagcgatggatttgggagagttatgtgaggacacaatgacttacaaatgccctcggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgtcataggaacatccatcacccagaaggggattattttcattttgttaatgctagtaacaccatccatggccatgcgatgcgtgggaataggcagcagggacttcgtggaaggactgtcaggagcaacttgggtagacgtggtactggaacatggaagctgcgtcaccaccatggcgaaagacaaaccaacattggacattgaactcttgaagacggaagtcacaaaccctgccgttctgcgcaaactgtgcattgaagctaaaatatcaaacaccaccaccgactcaagatgtccaacacaaggagaagccacacttatggaagaacaagacgcgaactttgtgtgtcgacgaacgtttgtggacagaggctggggcaatggctgtgggctcttcggaaaaggaagcctaataacgtgtgctaagttcaagtgtgtgactaaactggaaggaaagatagttcaatatgaaaacttgaaatattcagtaatagtcaccgtccacactggagaccagcaccaggtgggaaatgaaagcacagaacatgggacaactgcaactataacaccccaagctcccacgtcggaaatacagctgaccgactacggagctctcacattggattgctcacccagaacaggactagactttaatgaaatggtgttgttgacaatgaaagaaaaatcatggctagtccataaacaatggtttctagacctaccactgccttggacctcaggagcttcaacatcacaagagacttggaacagacaagacttgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacctgaaatgtagattaaagatggacaaactgactctaaaagggatgtcatatgtgatgtgcacaggctcattcaagctagagaaagaagtggctgagacccagcatggaaccgttttagtgcagattaaatacgaaggaacagatgcaccatgcaagatccctttttcgacccaagatgaaaaaggagtaacccagaatgggagattgataacagctaatcctatagtcactgacaaagaaaaaccagtcaacattgaggcagaaccgccttttggtgagagttacatcgtgataggagcaggtgaaaaagctttgaaactaagctggttcaagaaaggaagtagcatagggaaaatgtttgaggcaactgccagaggagcacgaagaatggccatactgggggacaccgcatgggactttggttctataggaggagtgttcacatctgttggaaaactagtacaccagatctttggaaccgcatatggagttttgttcagcggtgtttcctggaccatgaaaataggattaggggttctgctgacatggctaggattaaactcaaggagcacgtccctttcaatgacgtgcattgcagttggcctagtaacactatacctaggagtcatggttcaggcggattcaggatgtgtaattaattggaaaggtagagagctcaaatgtggaagtggcatttttgtcaccaatgaggttcacacttggacagagcaatacaaatttcaagctgactccccaaagagactatcagcagccatcgggaaggcatgggaggagggtgtgtgtggaattcgatcagccactcgtctcgagaatatcatgtggaagcaaatatcaaatgaactgaaccacatcttacttgaaaatgacatgaaatttacagtggttgtaggagatgtagttgggatcttggctcaagggaaaaaaatgatcaggccacaacccatggaacacaaatactcgtggaaaagctggggaaaagctaaaatcataggggcagatgtacagaacaccaccttcatcatcgacggcccaaacaccccagaatgccctgatgatcaaagagcatggaacatttgggaagttgaggactatggatttggaattttcacgacaaatatatggttgaaattgcgtgactcccacacccaagtgtgtgaccaccggctaatgtcagctgccatcaaggacagcaaggcagttcatgctgacatggggtactggatagaaagtgaaaagaacgagacctggaagctggcaagagcctctttcatagaagttaaaacatgcatttggccaaaatcccacactctatggagcaacggagttctggaaagtgaaatgataattccaaagatctatggaggaccaatatctcagcacaattacagaccaggatatttcacacaaacggcagggccgtggcacctaggtaagttggaactggattttgatttgtgtgagggtaccacagttgttgtggatgaacattgtggaaatcgaggaccatctcttagaaccacaacagtcacaggaaagataattcatgaatggtgttgcagatcttgtacgctaccacccttacgttttaaaggagaggatgggtgttggtacggtatggaaatcagaccagttaaggaaaaggaagagaatctagtcaaatcgatggtctctgcagggtcaggggaagtggacagcttttcactaggactgctatgcatatcaataatgatcgaagaggtgatgagatccagatggagtagaaaaatgttgatgactggaacactggctgtgttcctccttctcataatggggcaattgacatggaatgatctgatcagattatgcatcatggttggagccaacgcttccgacaggatggggatgggaacgacgtacctagctctgatggccacttttaaaatgagaccaatgtttgctgtcgggctattattccgtagactaacatccagagaagttctccttcttacaattggattgagtctagtggcatctgtggagttaccaaattccttggaggagctgggggatggacttgcaatgggcattatgattttaaaattattgactgactttcagtcacatcagctgtgggctaccttgctgtccttgacatttattaaaacaacgctttccttacactatgcatggaagacaatggctatggtactgtcaattgtatctctcttccccttatgcctgtccacgacctcccaaaaaacaacgtggcttccggtgctattgggatctcttggatgcaaaccactagccatgtttcttatagcagaaaacaaaatctggggaaggaaaagttggcccctcaatgaaggaattatggctgttggagtagtcagcatcctactaagttcactcctcaaaaatgatgtgccgctagctgggccactaatagctggaggcatgctaatagcatgttatgttatatctggaagctcagccgacttatcactagagaaagcggctgaggtctcctgggaagaagaagcagaacactctggtgcctcacacaacatattagtggaggtccaagatgatggaactatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgctatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtacttatgtaccaagggaagagactagaaccgagttgggccagtgtcaaaaaagacctgatctcatatggaggaggttggaggcttcaaggatcttggaacacgggagaagaagtgcaggtgattgctgttgaaccaggaaaaaaccccaaaaatgtacaaacagcgccaggcaccttcaagacccctgaaggtgaagttggagccattgccctagattttaaacccggcacatctggatctcccatcgtgaacagagaaggaaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcggggaaaacaagaagatatctcccagccatagtccgtgaggccataaaaaggaagctgcgcacactaattttggctcccacaagggttgtcgcttccgaaatggcagaggcgctcaagggaatgccaataaggtaccaaacaacagcagtgaagagtgaacacacaggaaaagagatagttgacctcatgtgccacgccactttcaccatgcgtctcctgtctcccgtgagagttcccaattacaacatgattatcatggatgaagcacatttcaccgatccatccagtatagcagccagagggtacatctcaacccgagtgggcatgggtgaagcagctgcgatcttcatgacagccactcccccaggatcggtggaggcctttccacagagcaatgcagttatccaagatgaggaaagagacattcctgagagatcatggaactcaggatatgagtggatcactgacttcccaggtaaaacagtttggtttgttccaagcatcaaatcaggaaatgacattgccaactgcttaagaaagaatgggaaacgggtaattcaattgagcagaaaaacctttgatacagagtaccaaaaaacaaaaaataacgattgggactatgtcgtcacaacagacatctccgaaatgggagcaaacttccgagccgacagggtgatagacccaagacggtgtctgaaaccggtaatactaaaagatggtccagagcgcgtcattctagcaggaccgatgccagtaactgtagccagtgccgcccagaggagaggaagaattggaaggaaccacaataaggaaggtgatcagtacatctacatgggacagcctttaaacaacgacgaagatcacgctcactggacagaagcaaaaatgctccttgataatataaacacaccagaagggatcatcccagccctcttcgagccagagagggaaaagagtgcagcaatagacggggaatacagactgcggggtgaagcaaggaagacgtttgtggagctcatgagaagaggagatctacctgtctggctatcctacaaagttgcctcagaaggcttccagtactctgatagaagatggtgcttcgacggggaaaggaacaatcaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagtgtctcaggtgatctaatattagaaatagggaaacttccacaacacttgacgcaaagggcccagaatgccttggacaacctggtcatgttgcacaactccgaacaaggaggaagagcctatagacatgcaatggaagaattgccagacaccatagaaacgttgatgctcctagctttgatagctgtgctgactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctaatggtgctgcttattccagagccagacagacaacgcactccgcaggacaatcagctggcatatgtggtgataggtttgttattcatgatactgacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagctatattgatgggacttgacaaaggatggccaatatcgaagatggacataggagttccacttctcgccttggggtgctattcacaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtctatgatgcaaaatttgagaaacagctaggccaaataatgttgttaatactatgcacttcacagatcctcttgatgaggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctttaggaggaggtaggagaggcacgggagcccaaggggaaacactgggagagaaatggaaaaggcagctgaaccaactgagcaagtcagaattcaacatttacaaaaggagtgggataatggaagtggacagatccgaagccaaagagggactgaaaagaggagaaacaaccagacatgcagtgtcgagaggaaccgccaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattctttacaccacctgagaaatgtgacacccttttgtgtgatattggtgagtcctctccaaacccaaccatagaagaaggaagaacgttacgcgtcctaaaaatggtggaaccatggctcagagggaaccaattttgcataaaaattctaaatccttacatgccaagtgtggtggaaactctggagcaaatgcaaagaaaacatggaggaatgctagtgcgaaatccactctcaagaaattctactcatgaaatgtattgggtttcatgtggaacaggaaacattgtgtcagcagtaaacatgacatctagaatgttactaaatcgattcacaatggctcacaggaaaccaacatatgaaagagacgtggacctaggcgctggaactagacatgtggcagtggaaccagaggtagccaacctggatatcattggccagaggatagagaacataaaacatgaacacaagtcaacatggcattatgatgaggacaatccatataaaacatgggcctatcacggatcatatgaggtcaagccatcaggatcagcctcatccatggtcaatggcgtagtgaaactgctcaccaaaccatgggatgtcatccccatggtcacacaaatagccatgactgacactacaccctttggacaacagagggtgttcaaagagaaagttgacacgcgcacaccaaaagcaaaacgaggcacagcacaaatcatggaggtgacagccagatggttatggggttttctttctagaaacaaaaaaccaagaatttgtacaagagaggagttcacaagaaaagtcaggtcaaacgcagccattggagcagtgttcgttgatgaaaatcaatggaactcagcaaaagaagcagtggaagatgagcggttctgggaccttgtgcaaaaagagagggagcttcacaaacagggaaaatgtgccacgtgtgtttacaacatgatggggaagagagagaaaaagctaggagagttcggaaaggcaaaagggagtcgtgcaatatggtacatgtggttgggagcacgttttctagagttcgaagctcttggtttcatgaacgaagatcactggttcagtagagagaattcactcagcggagtggaaggagaaggactccacaaactcggatacatactcagagatatatcaaagattccagggggaaatatgtatgcagatgacacagccggatgggatacaaggataacagaggatgatcttcagaatgaggccagaattactgacatcatggagcccgaacatgccctactggctacgtcaatctttaagctgacctaccaaaataaggtggtgagggtacagagaccagcaaaaaatggaaccgtgatggatgtcatatccagacgtgaccaaagaggaagtggccaggtcggaacttatggcttaaacactttcaccaacatggaagcccagctaataagacaaatggagtctgaaggaatctttttacccagcgaattggagacccaaaatttagccgagagggttctcgactggctggaaaaatatggcgtcgaaaggctgaaaagaatggcaatcagcggagatgactgcgtggtgaaaccaattgatgacaggttcgcaacagccctaacagctctgaatgatatgggaaaagtaagaaaagatataccacaatgggaaccttcaaaaggatggaatgactggcaacaagtgcctttttgttcacaccacttccaccagctgataatgaaggacgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagtcgcaccacctggtcgatccatgcccaccaccaatggatgacaacagaagacatgttgtcagtgtggaatagggtttggatagaggaaaacccatggatggaggacaaaacccatgtatccagttggggagatgttccatatctagggaaaagggaagatcagtggtgtggatccctgataggcttaacagcaagggccacctgggcttccaacatacaagtggccataaaccaagtgagaagactaattgggaatgagaattatctagattacatgacatcaatgaagagattcaagaacgagggtgatcccgaaggggcactctggtga

SEQ ID NO: 5860 - RNA, 9879 nt, synthetic construct
  misc_feature 1..9879: note = derived and/or modified CDS sequence (wt) from DENV-1__GQ199785__SS-prME
  source 1..9879: mol_type = other RNA
tctgtgaccatgctccttatgctgatgcctacagccttggcattccatttgactacacgaggaggagagccgcacatgatagttagcaagcaggaaagaggaaagtcacttttgttcaagacctcagcaggtgttaacatgtgcaccctcatagcgatggatttgggagagttatgtgaggacacaatgacttacaaatgtcctcgaattactgaggtggaaccagatgacgttgattgttggtgcaacaccacagacacatgggtgacctatggaacatgttcccaaactggcgagcaccgacgagacaagcgttccgtcgcactggccccacacgtgggacttggtttagaaacaagagccgaaacgtggatgtcctctgaaggcgcttggaaacagatacaaaaagtggagacttgggctctgagacacccaggattcacggtgatagccctttttctagcacatgccataggaacatccatcacccagaaagggattattttcattctgttaatgctggtgacaccttccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacattggtggaagaacaagacgcgaactttgtgtgccgacgaacgttcgtggacagaggctggggcaatggctgtgggctcttcggaaaaggaagcctgataacgtgtgctaagttcaagtgtgtgacaaaactggaaggaaagatagttcaatatgaaaatttgaaatattcagtaatagtcaccgtccacactggagaccagcaccaggtgggaaatgagagcacagaacatgggacaactgcaactataacacctcaagctcctacgtcggaaatacagctgaccgactacggagctcttacattggactgctcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtccggaacgacaacaatttttgcaggacacctgaaatgtagactaaagatggacaaactgactctaaaagggatgtcatatgtgatgtgcacaggttcattcaagctagagaaagaagtggctgagacccagcatggaaccgttttagtgcagattaaatacgaaggaacagatgcaccatgcaagatccctttttcgacccaagatgaaaaaggagtaacccagaacgggagattgataacagctaaccccatagtcactgacaaagaaaaaccagtcaacattgaggcagaaccgccttttggtgagagttacatcgtgataggagcaggcgaaaaagctttgaaactaagctggttcaagaaaggaagcagcatagggaaaatgtttgaggcaactgccagaggagcacgaaggatggccatattgggagataccgcatgggactttggttctataggaggagtgttcacgtctgttggaaaactagtacaccagatttttggaactgcatatggagttttgttcagcggtgtttcctggaccatgaagataggaataggggttctgctgacatggctaggattaaactcaaggagcacgtccctttcgatgacgtgcattgcagttggtctagtaacactatacctaggagtcatggttcaggcggattcaggatgtgtgattaattggaagggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagccacccgtctcgagaatatcatgtggaggcaaatatcaaatgaactgaaccacatcttacttgaaaatgacatgaaattcacagtagttgtaggagatgttgttgggatcttggctcaaggaaaaaagatgattaggccacaacccatggaacacaaatactcgtggaaaagctggggaaaagctaaaatcataggggcagatgtacagaacaccaccttcatcatcgatggcccaaacaccccagaatgccctgatgatcaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgatatggggtactggatagaaagtgaaaagaatgagacctggaagctggcaagagcctcttttatagaagttaaaacatgtatctggccaaaatcccacaccctatggagcaatggagttctggaaagtgaaatgataattccaaaaatctatggaggaccaatatctcagcacaactacagaccaggatatttcacacaaacggcagggccgtggcacctaggcaagttggaactggattttgatttatgtgagggtaccacagttgttgtggatgaacattgtggaaatcgaggaccatctcttagaaccacaacagtcacaggaaagataattcatgaatggtgttgcagatcttgcacgctaccacccttacgtttcaaaggagaagatgggtgttggtacggtatggaaatcagaccagtcaaggaaaaggaagagaatctagtcaaatcaatggtctcagcagggtcaggggaagtggacagcttttcactaggactgttatgcatatcaataatgatcgaagaggtgatgagatccagatggagtagaaaaatgctgatgactggaacactggctgtgttcttccttctcataatgggacaattgacatggaatgatctgatcaggtcatgcatcatggttggagccaacgcttccgacaggatggggatgggaacgacgtatctagctttgatggccacttttaaaatgagaccaatgtttgctgtcgggctattattccgcagactaacatccagagaagttcttcttctaacaattggattgagtctagtggcatctgtggagttaccaaattccttggaggagctgggggatggacttgcaatgggcattatgattttaaaattattgactgattttcagtcatatcagctgtgggctaccttgctgtccttgacatttatcaaaacaacgttttccttgcactatgcatggaagacaatggctatggtactgtcaattgtatctctcctccccttatgcctgtccacgacctcccaaaaaacaacatggctcccggtgctattgggatctcttggatgcaaaccactaaccatgtttctaatagcagaaaacaaaatctggggaaggaaaagttggcccctcaatgaaggaatcatggctgttggcatagtcagcatcctactaagttcactcctcaaaaatgatgtgccgctagctgggccactaatagctggaggcatgctaatagcatgttatgttatatcaggaagctcagccgacctatcactagagaaagcggctgaggtctcttgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagttgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcaccttcaagacccctgaaggtgaagttggagccattgccttagatttcaaacccggcacatctggatctcctatcgtgaacagagaagggaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcgggaaaaacaagaagatatcttccagccatagtccgtgaggccataaaaaggaagctgcgcacactaattttggctcccacaagggttgtcgcttccgaaatggcagaggcgctcaaggggatgccaataaggtaccaaacaacagcagtgaagagtgaacacacaggaagagagatagttgatcttatgtgtcacgccactttcaccatgcgtctcctgtctcctgtgagagttcccaattacaacatgattatcatggatgaagcacatttcaccgatccatccagcatagcggccagaggatacatctcaacccgagtgggcatgggtgaagcagctgcgatcttcatgacagccactcccccaggatcggtggaagcctttccacagagcaatgcagttatccaagatgaagaaagagacattcctgaaagatcatggaactcaggctatgagtggatcactgacttcccaggtaaaacagtttggtttgttccaagcatcaaatcaggaaatgacattgccaactgcctaagaaagaatgggaaacgggtgattcaattgagcaggaaaacctttgatacagagtaccaaaaaacaaaaaataacgactgggactacgtcgttacaacagacatctccgaaatgggagcaaacttccgggctgacagggtgatagacccaagacggtgtctgaaaccggtaatactaaaagatggtccagagcgtgtcatcttagcaggaccgatgccagtgactgtggccagtgccgcccagaggagaggaagaattggaaggaaccacaataaggaaggtgatcagtacatctacatgggacagcccttaaacaacgatgaagatcacgcccactggacagaagcaaaaatgctccttgataatataaacacaccagaagggattatcccagccctcttcgaaccggagagagaaaagagtgcagcaatagacggggaatacagactgcggggtgaagcaaggaaaacgtttgtggagctcatgagaagaggagatctacctgtctggttatcctacaaagtcgcctcagaaggcttccagtactccgacagaagatggtgctttgacggggaaaggaacaaccaggtgttggaggagaacatggacgtggagatctggacaaaagaaggagaaagaaagaaactacgaccccgctggctagatgccagaacatactcagacccactggccctgcgcgagtttaaagagtttgcagcaggaagaagaagcgtctcaggtgatttaatactagaaatagggaaacttccacaacacttgacgcaaagggcccagaatgctttggacaacctggtcatgttgcacaactccgaacaaggaggaagagcctatagacatgcaatggaagaactgccagacactatagaaacgttgatgctcctagctttgatagctgtgttgactggtggagtgacgctgttcttcctatcaggaaagggcctagggaaaacatctatcggcctactctgcgtgatggcttcaagcgcactgctatggatggccagtgtggagccccattggatagcggcctccatcatactggagttcttcttgatggtgctgcttattccagagccagacagacaacgcactccgcaagacaaccagctggcatatgtggtgataggtttgttatttatgatacttacagtagcagccaatgagatgggactactggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacggcaaacatttccctgacagctattgcaaaccaggcagccatattgatgggacttgacaaaggatggccaatatcgaagatggacataggagttccacttctagccttggggtgctattcccaagtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattctggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctacaaaaggagtgggataatggaagtggacagatccgaagccaaagagggactaagaagaggagaaacaaccaaacatgcagtgtcgagaggaaccgccaaactgaggtggtttgtggagaggaatcttgtgaaaccagaagggaaagtcatagacctcggttgtggaagaggtggctggtcatactattgcgctgggctgaagaaagtcacagaagtgaagggatacacaaaaggaggacccggacatgaggaaccaatcccaatggcgacctatggatggaacctagtaaagctgcactccgggaaagacgtattctttataccacctgagaaatgtgacacccttttgtgtgatattggtgaatcctctccaaacccaactatagaggaaggaagaacgttacgcgtcctaaagatggtggaaccatggctcagaggaaaccaattctgcataaagattctgaatccctacatgccaagtgtggtggaaaccctggaacaaatgcaaagaaaacatggaggaatgctagtgcgaaatccactttcaagaaattctacccatgaaatgtattgggtttcatgtggaacaggaaacattgtgtcagcagtaaacatgacatctagaatgttgctaaatcgattcacaatggctcacaggaaaccaacatatgaaagagacgtggacctaggcgctggaacaagacatgtggcagtggaaccagaggtagccaatctggatatcattggccagaggatagagaacataaaacatgaacacaagtcaacatggcattatgatgaggacaatccatataaaacatgggcctatcatggatcatatgaggtcaagccatcaggatcagcctcatccatggttaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcactgcacaaatcatggaggtgacagccaagtggttatggggctttctttccagaaacaaaaaaccaagaatttgtacaagagaggagttcacaagaaaagttaggtcaaacgcagccattggggcagtgttcgttgatgaaaatcaatggaactcagcaaaagaagcggtggaagatgaacggttctgggaccttgtgcacagagagagggagcttcacaaacagggaaaatgcgccacgtgtgtttacaacatgatggggaagagagagaaaaagctaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaactcggatacatactcagagacatatcaaagattcctgggggaaatatgtatgcagatgacacagctggatgggatacaaggataacagaggatgaccttcagaatgaggccaaaattactgacatcatgaagcctgaacatgccctactggctacgtcaatcttcaagctgacctaccaaaataaggtggtaagggtacagagaccagcaagaaatggaaccgtgatggatgtcatatccagacgtgaccagagaggaagtggccaggtcggaacttatggcttaaacactttcaccaacatggaagcccagcttataagacaaatggagtctgagggaatcttttcacccagcgagttggagaccccaaatttagccgagagagttctcgactggctggaaaaacatggcgtcgaaaggctaaaaagaatggcaatcagcggagatgactgcgtggtgaaaccaattgatgacaggtttgcaacagccttatcagctctgaatgatatgggaaaagtaagaaaagatataccacaatgggaaccctcaaaaggatggaatgattggcaacaagtgcctttttgttcacaccacttccaccagctgattatgaaggatggaagggaaatagtggtgccatgccgcaaccaagatgaacttgtgggtagggctagagtatcacaaggtgctggatggagcctgagagaaactgcatgcctaggcaagtcatatgcacaaatgtggcaactgatgtacttccacaggagagacctgagactagccgctaatgctatctgttcagccgttccagttgattgggtcccaaccagccgtaccacctggtcgatccatgcccatcaccaatggatgacaacagaagacatgttgtcagtgtggaatagggtttggatagaggaaaacccatggatggaggacaaaacccatatatccagctggggagatgttccatatttaggaaaaagggaagatcagtggtgtggatccctgataggcttaacagcaagggccacctgggccaccaacatacaagtggccataaaccaagtgagaagactaattgggaatgagaattatttagattacatgacatcaatgaagagattcaagaacgagagtgatcctgaaggggcactctggtga

SEQ ID NO: 5861 - RNA, 9879 nt, synthetic construct
  misc_feature 1..9879: note = derived and/or modified CDS sequence (wt) from DENV-1__GQ199786__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcctggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaaccataacacctcaagctcctacgacggaaatacagctgaccgactacggagctcttacattggattgttcacccagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtatggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcctctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggccgaggtctcctgggaagaagaagcagaacactctggcgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacattttaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgatccaattgagcaggaaaacctttgatacagagtaccaaaaaacaaaaaacaacgactgggactacgtcgtcacaacagacatctcagaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagccttgatagctgtgttaactggtggagtgatactgttcttcctatcaggaaggggcctagggaaaacatctattggcctactctgcgtaatggcttcaagcgtactgctatggatggccagtgtggagccccattggatagcggcctccatcatactggagttcttcttgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggcccattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaggtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgcaggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga
